(12) United States Patent
Pompejus et al.

(10) Patent No.: US 6,822,084 B1
(45) Date of Patent: Nov. 23, 2004

(54) CORYNEBACTERIUM GLUTAMICUM GENES ENCODING STRESS, RESISTANCE AND TOLERANCE PROTEINS

(75) Inventors: Markus Pompejus, Freinsheim (DE); Burkhard Kroger, Limburgerhof (DE); Hartwig Schröder, Nussloch (DE); Oskar Zelder, Speyer (DE); Gregor Haberhauer, Limburgerhof (DE); Heung-Shick Lee, Seoul (KR); Hyung-Joon Kim, Seoul (KR)

(73) Assignee: BASF Aktiengesellschaft, Ludwigshafen (DE)

( * ) Notice: Subject to any disclaimer, the term of this patent is extended or adjusted under 35 U.S.C. 154(b) by 0 days.

(21) Appl. No.: 09/603,208

(22) Filed: Jun. 23, 2000

Related U.S. Application Data

(60) Provisional application No. 60/151,214, filed on Aug. 27, 1999, provisional application No. 60/142,692, filed on Jul. 1, 1999, and provisional application No. 60/141,031, filed on Jun. 25, 1999.

(30) Foreign Application Priority Data

| Jul. 1, 1999 | (DE) | 199 30 429 |
|---|---|---|
| Jul. 8, 1999 | (DE) | 199 31 457 |
| Jul. 8, 1999 | (DE) | 199 31 541 |
| Jul. 8, 1999 | (DE) | 199 31 413 |
| Jul. 9, 1999 | (DE) | 199 32 209 |
| Jul. 9, 1999 | (DE) | 199 32 230 |
| Jul. 14, 1999 | (DE) | 199 32 914 |
| Aug. 27, 1999 | (DE) | 199 40 764 |
| Aug. 31, 1999 | (DE) | 199 41 382 |

(51) Int. Cl.[7] ......................... C07H 21/04; C07H 21/02
(52) U.S. Cl. .................... 536/23.7; 536/23.1; 536/24.1; 536/24.3; 536/24.33; 530/350; 435/69.1; 435/252.3
(58) Field of Search ............... 536/23.7, 23.1, 536/24.1, 24.3, 24.33; 530/350; 435/69.1, 252.3, 6, 91.1, 320.1, 325

(56) References Cited

U.S. PATENT DOCUMENTS 4,649,119 A * 3/1987 Sinskey et al. ............. 435/317

FOREIGN PATENT DOCUMENTS

| EP | 0 252 558 A2 | 1/1988 |
|---|---|---|
| EP | 0 752 472 A1 | 1/1997 |
| FR | 2607827 A | 6/1988 |
| WO | WO 88/09819 A2 A3 | 12/1988 |
| WO | WO 99/02692 A1 | 1/1999 |

OTHER PUBLICATIONS

Kunst et al. (Nature (1997) 390(6657): 249–256) and GenEmbl Accession No, Z99118).*
Yamane (GenEmbl Accession No. AB000617).*
Chan MS, et al. Cloning of m–fluorophenylalanine–resistant gene and mutational analysis of feedback–resistant prephenate dehydratase from *Corynebacterium glutemicum*. Biochem Biophys Res Commun. Feb. 15, 1996;219(2):537–42.
EBI [Online] AC AF237667, Corynebacterium glutamicum lincomycin resistance protein LmrB (lmrB) gene, complete cds. Mar. 14, 2000.
EBI [Online] AC X13385, *Entercoccus faecalis*; genome contig SEQ ID NO: 448 Mar. 19, 1999.
Jager W, et al. A *Corynebacterium glutamicum* gene conferring multidrug resistance in the heterologous host *Escherichia coli*. J Bacteriol. Apr. 1997;179(7):2449–51.
Peter H, et al. Corynebeacterium glutamicum is equipped with four secondary carriers for compatible solutes: identification, sequencing, and characterization of the proline/ectoine uptake system, ProP, and the ectoine/proline/glycine betaine carrier; EctP. J Bacteriol. Nov. 1998;180(22):6005–12.
Wehrmann A, et al. Different modes of diaminopimelate synthesis and their role in cell wall integrity: a study with *Corynebacterium glutamicum*. J Bacteriol. Jun. 1998;180(12):3159–65.

* cited by examiner

*Primary Examiner*—Carla J. Myers
*Assistant Examiner*—Alexander H. Spiegler
(74) *Attorney, Agent, or Firm*—Lahive & Cockfield, LLP; Elizabeth A. Hanley; Lisa M. DiRocco

(57) ABSTRACT

Isolated nucleic acid molecules, designated SRT nucleic acid molecules, which encode novel SRT proteins from *Corynebacterium glutamicum* are described. The invention also provides antisense nucleic acid molecules, recombinant expression vectors containing SRT nucleic acid molecules, and host cells into which the expression vectors have been introduced. The invention still further provides isolated SRT proteins, mutated SRT proteins, fusion proteins, antigenic peptides and methods for the improvement of production of a desired compound from *C. glutamicum* based on genetic engineering of SRT genes in this organism.

2 Claims, No Drawings

US 6,822,084 B1

CORYNEBACTERIUM GLUTAMICUM GENES ENCODING STRESS, RESISTANCE AND TOLERANCE PROTEINS

RELATED APPLICATIONS

This application claims priority to prior filed U.S. Provisional Patent Application Serial No. 60/141,031, filed Jun. 25, 1999, U.S. Provisional Patent Application Serial No. 60/142,692, filed Jul. 1, 1999, and also to U.S. Provisional Patent Application Serial No. 60/151,214, filed Aug. 27, 1999. This application also claims priority to German Patent Application No. 19930429.7, filed Jul. 1, 1999, German Patent Application No. 19931413.6, filed Jul. 8, 1999, German Patent Application No. 19931457.8, filed Jul. 8, 1999, German Patent Application No. 19931541.8, filed Jul. 8, 1999, German Patent Application No. 19932209.0, filed Jul. 9, 1999, German Patent Application No. 19932230.9, filed Jul. 9, 1999, German Patent Application No. 19932914.1, filed Jul. 14, 1999, German Patent Application No. 19940764.9, filed Aug. 27, 1999, and German Patent Application No. 19941382.7, filed Aug. 31, 1999. The entire contents of all of the aforementioned applications are hereby expressly incorporated herein in their entirety by this reference.

BACKGROUND OF THE INVENTION

Certain products and by-products of naturally-occurring metabolic processes in cells have utility in a wide array of industries, including the food, feed, cosmetics, and pharmaceutical industries. These molecules, collectively termed 'fine chemicals', include organic acids, both proteinogenic and non-proteinogenic amino acids, nucleotides and nucleosides, lipids and fatty acids, diols, carbohydrates, aromatic compounds, vitamins and cofactors, and enzymes. Their production is most conveniently performed through large-scale culture of bacteria developed to produce and secrete large quantities of a particular desired molecule. One particularly useful organism for this purpose is *Corynebacterium glutamicum*, a gram positive, nonpathogenic bacterium. Through strain selection, a number of mutant strains have been developed which produce an array of desirable compounds. However, selection of strains improved for the production of a particular molecule is a time-consuming and difficult process.

SUMMARY OF THE INVENTION

The invention provides novel bacterial nucleic acid molecules which have a variety of uses. These uses include the identification of microorganisms which can be used to produce fine chemicals, the modulation of fine chemical production in *C. glutamicum* or related bacteria, the typing or identification of *C. glutamicum* or related bacteria, as reference points for mapping the *C. glutamicum* genome, and as markers for transformation. These novel nucleic acid molecules encode proteins, referred to herein as stress, resistance and tolerance (SRT) proteins.

*C. glutamicum* is a gram positive, aerobic bacterium which is commonly used in industry for the large-scale production of a variety of fine chemicals, and also for the degradation of hydrocarbons (such as in petroleum spills) and for the oxidation of terpenoids. The SRT nucleic acid molecules of the invention, therefore, can be used to identify microorganisms which can be used to produce fine chemicals, e.g, by fermentation processes. Modulation of the expression of the SRT nucleic acids of the invention, or modification of the sequence of the SRT nucleic acid molecules of the invention, can be used to modulate the production of one or more fine chemicals from a microorganism (e.g. to improve the yield or production of one or more fine chemicals from a *Corynebacterium* or *Brevibacterium* species).

The SRT nucleic acids of the invention may also be used to identify an organism as being *Corynebacterium glutamicum* or a close relative thereof, or to identify the presence of *C. glutamicum* or a relative thereof in a mixed population of microorganisms. The invention provides the nucleic acid sequences of a number of *C glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present. Although *Corynebacterium glutamicum* itself is nonpathogenic, it is related to species pathogenic in humans, such as *Corynebacterium diphtheriae* (the causative agent of diphtheria); the detection of such organisms is of significant clinical relevance.

The SRT nucleic acid molecules of the invention may also serve as reference points for mapping of the *C. glutamicum* genome, or of genomes of related organisms. Similarly, these molecules, or variants or portions thereof, may serve as markers for genetically engineered *Corynebacterium* or *Brevibacterium* species.

The SRT proteins encoded by the novel nucleic acid molecules of the invention are capable of, for example, permitting *C. glutamicum* to survive in a setting which is either chemically or environmentally hazardous to this microorganism. Given the availability of cloning vectors for use in *Corynebacterium glutamicum*, such as those disclosed in Sinskey et al., U.S. Pat. No. 4,649,119, and techniques for genetic manipulation of *C. glutamicum* and the related Brevibacterium species (e.g., lactofermentum) (Yoshihama et al, *J. Bacteriol.* 162: 591–597 (1985); Katsumata et al., *J. Bacteriol.* 159: 306–311 (1984); and Santamaria et al, *J. Gen. Microbiol.* 130: 2237–2246 (1984)), the nucleic acid molecules of the invention may be utilized in the genetic engineering of this organism to make it a better or more efficient producer of one or more fine chemicals, through the ability of these proteins to permit growth and multiplication of *C. glutamicum* (and also continuous production of one or more fine chemicals) under circumstances which would normally impede growth of the organism, such as those conditions frequently encountered during large-scale fermentative growth. For example, by overexpressing or engineering a heat-shock induced protease molecule such that it is optimized in activity, one may increase the ability of the bacterium to degrade incorrectly folded proteins when the bacterium is challenged with high temperatures. By having fewer misfolded (and possibly misregulated or nonfunctional) proteins to interfere with normal reaction mechanisms in the cell, the cell is increased in its ability to function normally in such a culture, which should in turn provide increased viability. This overall increase in number of cells having greater viability and activity in the culture should also result in an increase in yield, production, and/or efficiency of production of one or more desired fine chemicals, due at least to the relatively greater number of cells producing these chemicals in the culture.

This invention provides novel SRT nucleic acid molecules which encode SRT proteins which are capable of, for example, permitting *C. glutamicum* to survive in a setting which is either chemically or environmentally hazardous to this microorganism. Nucleic acid molecules encoding an SRT protein are referred to herein as SRT nucleic acid molecules. In a preferred embodiment, the SRT protein participates in metabolic pathways permitting *C. glutamicum* to survive in a setting which is either chemically or environmentally hazardous to this microorganism. Examples of such proteins include those encoded by the genes set forth in Table 1.

Accordingly, one aspect of the invention pertains to isolated nucleic acid molecules (e.g., cDNAs, DNAs, or RNAs) comprising a nucleotide sequence encoding an SRT protein or biologically active portions thereof, as well as nucleic acid fragments suitable as primers or hybridization probes for the detection or amplification of SRT-encoding nucleic acid (e.g., DNA or mRNA). In particularly preferred embodiments, the isolated nucleic acid molecule comprises one of the nucleotide sequences set forth in Appendix A or the coding region or a complement thereof of one of these nucleotide sequences. In other particularly preferred embodiments, the isolated nucleic acid molecule of the invention comprises a nucleotide sequence which hybridizes to or is at least about 50%, preferably at least about 60%, more preferably at least about 70%, 80% or 90%, and even more preferably at least about 95%, 96%, 97%, 98%, 99% or more homologous to a nucleotide sequence set forth in Appendix A, or a portion thereof. In other preferred embodiments, the isolated nucleic acid molecule encodes one of the amino acid sequences set forth in Appendix B. The preferred SRT proteins of the present invention also preferably possess at least one of the SRT activities described herein.

In another embodiment, the isolated nucleic acid molecule encodes a protein or portion thereof wherein the protein or portion thereof includes an amino acid sequence which is sufficiently homologous to an amino acid sequence of Appendix B, e.g., sufficiently homologous to an amino acid sequence of Appendix B such that the protein or portion thereof maintains an SRT activity. Preferably, the protein or portion thereof encoded by the nucleic acid molecule maintains the ability to increase the survival of *C. glutamicum* in a setting which is either chemically or environmentally hazardous to this microorganism. In one embodiment, the protein encoded by the nucleic acid molecule is at least about 50%, preferably at least about 60%, and more preferably at least about 70%, 80%, or 900% and most preferably at least about 95%, 96%, 97%, 98%, or 99% or more homologous to an amino acid sequence of Appendix B (e.g., an entire amino acid sequence selected from those sequences set forth in Appendix B). In another preferred embodiment, the protein is a full length *C. glutamicum* protein which is substantially homologous to an entire amino acid sequence of Appendix B (encoded by an open reading frame shown in Appendix A).

In another preferred embodiment, the isolated nucleic acid molecule is derived from *C. glutamicum* and encodes a protein (e.g., an SRT fusion protein) which includes a biologically active domain which is at least about 50% or more homologous to one of the amino acid sequences of Appendix B and has the ability to increase the survival of *C. glutamicum* in a setting which is either chemically or environmentally hazardous to this microorganism, or possesses one or more of the activities set forth in Table 1, and which also includes heterologous nucleic acid sequences encoding a heterologous polypeptide or regulatory regions.

In another embodiment, the isolated nucleic acid molecule is at least 15 nucleotides in length and hybridizes under stringent conditions to a nucleic acid molecule comprising a nucleotide sequence of Appendix A. Preferably, the isolated nucleic acid molecule corresponds to a naturally-occurring nucleic acid molecule. More preferably, the isolated nucleic acid encodes a naturally-occurring *C. glutamicum* SRT protein, or a biologically active portion thereof.

Another aspect of the invention pertains to vectors, e.g., recombinant expression vectors, containing the nucleic acid molecules of the invention, and host cells into which such vectors have been introduced. In one embodiment, such a host cell is used to produce an SRT protein by culturing the host cell in a suitable medium. The SRT protein can be then isolated from the medium or the host cell.

Yet another aspect of the invention pertains to a genetically altered microorganism in which an SRT gene has been introduced or altered. In one embodiment, the genome of the microorganism has been altered by the introduction of a nucleic acid molecule of the invention encoding wild-type or mutated SRT sequence as a transgene. In another embodiment, an endogenous SRT gene within the genome of the microorganism has been altered, e.g., functionally disrupted, by homologous recombination with an altered SRT gene. In another embodiment, an endogenous or introduced SRT gene in a microorganism has been altered by one or more point mutations, deletions, or inversions, but still encodes a functional SRT protein. In still another embodiment, one or more of the regulatory regions (e.g., a promoter, repressor, or inducer) of a SRT gene in a microorganism has been altered (e.g. by deletion, truncation, inversion, or point mutation) such that the expression of the SRT gene is modulated. In a preferred embodiment, the microorganism belongs to the genus *Corynebacterium* or *Brevibacterium*, with *Corynebacterium glutamicum* being particularly preferred. In a preferred embodiment, the microorganism is also utilized for the production of a desired compound, such as an amino acid, with lysine being particularly preferred.

In another aspect, the invention provides a method of identifying the presence or activity of *Cornyebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject.

Still another aspect of the invention pertains to an isolated SRT protein or a portion, e.g., a biologically active portion, thereof. In a preferred embodiment, the isolated SRT protein or portion thereof possesses the ability to increase the survival of *C. glutamicum* in a setting which is either chemically or environmentally hazardous to this microorganism. In another preferred embodiment, the isolated SRT protein or portion thereof is sufficiently homologous to an amino acid sequence of Appendix B such that the protein or portion thereof maintains the ability to increase the survival of *C. glutamicum* in a setting which is either chemically or environmentally hazardous to this microorganism.

The invention also provides an isolated preparation of an SRT protein. In preferred embodiments, the SRT protein comprises an amino acid sequence of Appendix B. In another preferred embodiment, the invention pertains to an isolated full length protein which is substantially homologous to an entire amino acid sequence of Appendix B (encoded by an open reading frame set forth in Appendix A). In yet another embodiment, the protein is at least about 50%, preferably at least about 60%, and more preferably at least about 70%, 80%, or 90%, and most preferably at least about 95%, 96%, 97%, 98%, or 99% or more homologous to an entire amino acid sequence of Appendix B. In other embodiments, the isolated SRT protein comprises an amino acid sequence which is at least about 50% or more homologous to one of the amino acid sequences of Appendix B and is able to improve the survival rate of *C. glutamicum* in a setting which is either chemically or environmentally hazardous to this microorganism, or has one or more of the activities set forth in Table 1.

Alternatively, the isolated SRT protein can comprise an amino acid sequence which is encoded by a nucleotide sequence which hybridizes, e.g., hybridizes under stringent conditions, or is at least about 50%, preferably at least about 60%, more preferably at least about 70%, 80%, or 90%, and even more preferably at least about 95%, 96%, 97%, 98,%, or 99% or more homologous, to a nucleotide sequence of Appendix B. It is also preferred that the preferred forms of SRT proteins also have one or more of the SRT bioactivities described herein.

The SRT polypeptide, or a biologically active portion thereof, can be operatively linked to a non-SRT polypeptide to form a fusion protein. In preferred embodiments, this fusion protein has an activity which differs from that of the SRT protein alone. In other preferred embodiments, this fusion protein results in increased yields, production, and/or efficiency of production of a desired fine chemical from *C. glutamicum*. In particularly preferred embodiments, integration of this fusion protein into a host cell modulates the production of a desired compound from the cell.

In another aspect, the invention provides methods for screening molecules which modulate the activity of an SRT protein, either by interacting with the protein itself or a substrate or binding partner of the SRT protein, or by modulating the transcription or translation of an SRT nucleic acid molecule of the invention.

Another aspect of the invention pertains to a method for producing a fine chemical. This method involves the culturing of a cell containing a vector directing the expression of an SRT nucleic acid molecule of the invention, such that a fine chemical is produced. In a preferred embodiment, this method further includes the step of obtaining a cell containing such a vector, in which a cell is transfected with a vector directing the expression of an SRT nucleic acid. In another preferred embodiment, this method further includes the step of recovering the fine chemical from the culture. In a particularly preferred embodiment, the cell is from the genus *Corynebacterium* or *Brevibacterium*, or is selected from those strains set forth in Table 3.

Another aspect of the invention pertains to methods for modulating production of a molecule from a microorganism. Such methods include contacting the cell with an agent which modulates SRT protein activity or SRT nucleic acid expression such that a cell associated activity is altered relative to this same activity in the absence of the agent. In a preferred embodiment, the cell is modulated in resistance to one or more toxic chemicals or in resistance to one or more environmental stresses, such that the yields or rate of production of a desired fine chemical by this microorganism is improved. The agent which modulates SRT protein activity can be an agent which stimulates SRT protein activity or SRT nucleic acid expression. Examples of agents which stimulate SRT protein activity or SRT nucleic acid expression include small molecules, active SRT proteins, and nucleic acids encoding SRT proteins that have been introduced into the cell. Examples of agents which inhibit SRT activity or expression include small molecules, and antisense SRT nucleic acid molecules.

Another aspect of the invention pertains to methods for modulating yields of a desired compound from a cell, involving the introduction of a wild-type or mutant SRT gene into a cell, either maintained on a separate plasmid or integrated into the genome of the host cell. If integrated into the genome, such integration can random, or it can take place by homologous recombination such that the native gene is replaced by the introduced copy, causing the production of the desired compound from the cell to be modulated. In a preferred embodiment, said yields are increased. In another preferred embodiment, said chemical is a fine chemical. In a particularly preferred embodiment, said fine chemical is an amino acid. In especially preferred embodiments, said amino acid is L-lysine.

DETAILED DESCRIPTION OF THE INVENTION

The present invention provides SRT nucleic acid and protein molecules which are involved in the survival of *C. glutamicum* upon exposure of this microorganism to chemical or environmental hazards. The molecules of the invention may be utilized in the modulation of production of fine chemicals from microorganisms, since these SRT proteins provide a means for continued growth and multiplication of *C. glutamicum* in the presence of toxic chemicals or hazardous environmental conditions, such as may be encountered during large-scale fermentative growth. By increasing the growth rate or at least maintaining normal growth in the face of poor, if not toxic, conditions, one may increase the yield, production, and/or efficiency of production of one or more fine chemicals from such a culture, at least due to the relatively greater number of cells producing the fine chemical in the culture. Aspects of the invention are further explicated below.

I. Fine Chemicals

The term 'fine chemical' is art-recognized and includes molecules produced by an organism which have applications in various industries, such as, but not limited to, the pharmaceutical, agriculture, and cosmetics industries. Such compounds include organic acids, such as tartaric acid, itaconic acid, and diaminopimelic acid, both proteinogenic and non-proteinogenic amino acids, purine and pyrimidine bases, nucleosides, and nucleotides (as described e.g in Kuninaka, A. (1996) Nucleotides and related compounds, p. 561–612, in Biotechnology vol. 6, Rehm et al, eds. VCH: Weinheim, and references contained therein), lipids, both saturated and unsaturated fatty acids (e.g., arachidonic acid), diols (e.g., propane diol, and butane diol), carbohydrates (e.g., hyaluronic acid and trehalose), aromatic compounds (e.g., aromatic amines, vanillin, and indigo), vitamins and cofactors (as described in Ullmann's Encyclopedia of Industrial Chemistry, vol. A27, "Vitamins", p. 443–613 (1996) VCH: Weinheim and references therein; and Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1–3, 1994 at Penang, Malaysia, AOCS Press, (1995)), enzymes, polyketides (Cane et al. (1998) *Science* 282: 63–68), and all other chemicals described in Gutcho (1983) Chemicals by Fermentation, Noyes Data Corporation, ISBN: 0818805086 and references therein. The metabolism and uses of certain of these fine chemicals are further explicated below.

A. Amino Acid Metabolism and Uses

Amino acids comprise the basic structural units of all proteins, and as such are essential for normal cellular functioning in all organisms. The term "amino acid" is art-recognized. The proteinogenic amino acids, of which there are 20 species, serve as structural units for proteins, in which they are linked by peptide bonds, while the nonproteinogenic amino acids (hundreds of which are known) are not normally found in proteins (see Ulmann's Encyclopedia of Industrial Chemistry, vol. A2, p. 57–97 VCH: Weinheim (1985)). Amino acids may be in the D- or L-optical configuration, though L-amino acids are generally the only type found in naturally-occurring proteins. Biosynthetic and degradative pathways of each of the 20 proteinogenic amino acids have been well characterized in both prokaryotic and eukaryotic cells (see, for example, Stryer, L. Biochemistry, $3^{rd}$ edition, pages 578–590 (1988)). The 'essential' amino acids (histidine, isoleucine, leucine, lysine, methionine, phenylalanine, threonine, tryptophan, and valine), so named because they are generally a nutritional requirement due to the complexity of their biosyntheses, are readily converted by simple biosynthetic pathways to the remaining 11 'nonessential' amino acids (alanine, arginine, asparagine, aspartate, cysteine, glutamate, glutamine, glycine, proline, serine, and tyrosine). Higher animals do retain the ability to synthesize some of these amino acids, but the essential amino acids must be supplied from the diet in order for normal protein synthesis to occur.

Aside from their function in protein biosynthesis, these amino acids are interesting chemicals in their own right, and many have been found to have various applications in the food, feed, chemical, cosmetics, agriculture, and pharmaceutical industries. Lysine is an important amino acid in the nutrition not only of humans, but also of monogastric animals such as poultry and swine. Glutamate is most commonly used as a flavor additive (mono-sodium glutamate, MSG) and is widely used throughout the food industry, as are aspartate, phenylalanine, glycine, and cysteine. Glycine, L-methionine and tryptophan are all utilized in the pharmaceutical industry. Glutamine, valine, leucine, isoleucine, histidine, arginine, proline, serine and alanine are of use in both the pharmaceutical and cosmetics industries. Threonine, tryptophan, and D/L-methionine are common feed additives. (Leuchtenberger, W. (1996) Amino aids-technical production and use, p. 466–502 in Rehm et al. (eds.) Biotechnology vol. 6, chapter 14a, VCH: Weinheim). Additionally, these amino acids have been found to be useful as precursors for the synthesis of synthetic amino acids and proteins, such as N-acetylcysteine, S-carboxymethyl-L-cysteine, (S)-5-hydroxytryptophan, and others described in Ulmann's Encyclopedia of Industrial Chemistry, vol. A2, p. 57–97, VCH: Weinheim. 1985.

The biosynthesis of these natural amino acids in organisms capable of producing them, such as bacteria, has been well characterized (for review of bacterial amino acid biosynthesis and regulation thereof, see Umbarger, H. E.(1978) Ann. Rev. Biochem. 47: 533–606). Glutamate is synthesized by the reductive amination of α-ketoglutarate, an intermediate in the citric acid cycle. Glutamine, proline, and arginine are each subsequently produced from glutamate. The biosynthesis of serine is a three-step process beginning with 3-phosphoglycerate (an intermediate in glycolysis), and resulting in this amino acid after oxidation, transamination, and hydrolysis steps. Both cysteine and glycine are produced from serine; the former by the condensation of homocysteine with serine, and the latter by the transferal of the side-chain β-carbon atom to tetrahydrofolate, in a reaction catalyzed by serine transhydroxymethylase. Phenylalanine, and tyrosine are synthesized from the glycolytic and pentose phosphate pathway precursors erythrose 4-phosphate and phosphoenolpyruvate in a 9-step biosynthetic pathway that differ only at the final two steps after synthesis of prephenate. Tryptophan is also produced from these two initial molecules, but its synthesis is an 11-step pathway. Tyrosine may also be synthesized from phenylalanine, in a reaction catalyzed by phenylalanine hydroxylase. Alanine, valine, and leucine are all biosynthetic products of pyruvate, the final product of glycolysis. Aspartate is formed from oxaloacetate, an intermediate of the citric acid cycle. Asparagine, methionine, threonine, and lysine are each produced by the conversion of aspartate. Isoleucine is formed from threonine. A complex 9-step pathway results in the production of histidine from 5-phosphoribosyl-1-pyrophosphate, an activated sugar.

Amino acids in excess of the protein synthesis needs of the cell cannot be stored, and are instead degraded to provide intermediates for the major metabolic pathways of the cell (for review see Stryer, L. Biochemistry $3^{rd}$ ed. Ch. 21 "Amino Acid Degradation and the Urea Cycle" p. 495–516 (1988)). Although the cell is able to convert unwanted amino acids into useful metabolic intermediates, amino acid production is costly in terms of energy, precursor molecules, and the enzymes necessary to synthesize them. Thus it is not surprising that amino acid biosynthesis is regulated by feedback inhibition, in which the presence of a particular amino acid serves to slow or entirely stop its own production (for overview of feedback mechanisms in amino acid biosynthetic pathways, see Stryer, L. Biochemistry, 3d ed. Ch. 24: "Biosynthesis of Amino Acids and Heme" p. 575–600 (1988)). Thus, the output of any particular amino acid is limited by the amount of that amino acid present in the cell.

B. Vitamin, Cofactor, and Nutraceutical Metabolism and Uses

Vitamins, cofactors, and nutraceuticals comprise another group of molecules which the higher animals have lost the ability to synthesize and so must ingest, although they are readily synthesized by other organisms, such as bacteria. These molecules are either bioactive substances themselves, or are precursors of biologically active substances which may serve as electron carriers or intermediates in a variety of metabolic pathways. Aside from their nutritive value, these compounds also have significant industrial value as coloring agents, antioxidants, and catalysts or other processing aids. (For an overview of the structure, activity, and industrial applications of these compounds, see, for example, Ullman's Encyclopedia of Industrial Chemistry, "Vitamins" vol. A27, p. 443–613, VCH: Weinheim, 1996.) The term "vitamin" is art-recognized, and includes nutrients which are required by an organism for normal functioning, but which that organism cannot synthesize by itself. The group of vitamins may encompass cofactors and nutraceutical compounds. The language "cofactor" includes nonproteinaceous compounds required for a normal enzymatic activity to occur. Such compounds may be organic or inorganic; the cofactor molecules of the invention are preferably organic. The term "nutraceutical" includes dietary supplements having health benefits in plants and animals, particularly humans. Examples of such molecules are vitamins, antioxidants, and also certain lipids (e.g., polyunsaturated fatty acids).

The biosynthesis of these molecules in organisms capable of producing them, such as bacteria, has been largely characterized (Ullman's Encyclopedia of Industrial Chemistry, "Vitamins" vol. A27, p.443–613, VCH: Weinheim, 1996; Michal, G. (1999) Biochemical Pathways: An Atlas of Biochemistry and Molecular Biology, John Wiley & Sons; Ong, A. S., Niki, E. & Packer, L. (1995) "Nutrition, Lipids, Health, and Disease" Proceedings of the UNESCO/

Confederation of Scientific and Technological Associations in Malaysia, and the Society for Free Radical Research—Asia, held Sep. 1–3, 1994 at Penang, Malaysia, AOCS Press: Champaign, Ill. X, 374 S).

Thiamin (vitamin $B_1$) is produced by the chemical coupling of pyrimidine and thiazole moieties. Riboflavin (vitamin $B_2$) is synthesized from guanosine-5'-triphosphate (GTP) and ribose-5'-phosphate. Riboflavin, in turn, is utilized for the synthesis of flavin mononucleotide (FMN) and flavin adenine dinucleotide (FAD). The family of compounds collectively termed 'vitamin $B_6$' (e.g., pyridoxine, pyridoxamine, pyridoxa-5'-phosphate, and the commercially used pyridoxin hydrochloride) are all derivatives of the common structural unit, 5-hydroxy-6-methylpyridine. Pantothenate (pantothenic acid, (R)—(+)—N—(2,4-dihydroxy-3,3-dimethyl-1-oxobutyl)-β-alanine) can be produced either by chemical synthesis or by fermentation. The final steps in pantothenate biosynthesis consist of the ATP-driven condensation of β-alanine and pantoic acid. The enzymes responsible for the biosynthesis steps for the conversion to pantoic acid, to β-alanine and for the condensation to panthotenic acid are known. The metabolically active form of pantothenate is Coenzyme A, for which the biosynthesis proceeds in 5 enzymatic steps. Pantothenate, pyridoxal-5'-phosphate, cysteine and ATP are the precursors of Coenzyme A. These enzymes not only catalyze the formation of pantothante, but also the production of (R)-pantoic acid, (R)-pantolacton, (R)-panthenol (provitamin $B_5$), pantetheine (and its derivatives) and coenzyme A.

Biotin biosynthesis from the precursor molecule pimeloyl-CoA in microorganisms has been studied in detail and several of the genes involved have been identified. Many of the corresponding proteins have been found to also be involved in Fe-cluster synthesis and are members of the nifS class of proteins. Lipoic acid is derived from octanoic acid, and serves as a coenzyme in energy metabolism, where it becomes part of the pyruvate dehydrogenase complex and the α-ketoglutarate dehydrogenase complex. The folates are a group of substances which are all derivatives of folic acid, which is turn is derived from L-glutamic acid, p-aminobenzoic acid and 6-methylpterin. The biosynthesis of folic acid and its derivatives, starting from the metabolism intermediates guanosine-5'-triphosphate (GTP), L-glutamic acid and p-amino-benzoic acid has been studied in detail in certain microorganisms.

Corrinoids (such as the cobalamines and particularly vitamin $B_{12}$) and porphyrines belong to a group of chemicals characterized by a tetrapyrole ring system. The biosynthesis of vitamin $B_{12}$ is sufficiently complex that it has not yet been completely characterized, but many of the enzymes and substrates involved are now known. Nicotinic acid (nicotinate), and nicotinamide are pyridine derivatives which are also termed 'niacin'. Niacin is the precursor of the important coenzymes NAD (nicotinamide adenine dinucleotide) and NADP (nicotinamide adenine dinucleotide phosphate) and their reduced forms.

The large-scale production of these compounds has largely relied on cell-free chemical syntheses, though some of these chemicals have also been produced by large-scale culture of microorganisms, such as riboflavin, Vitamin $B_6$, pantothenate, and biotin. Only Vitamin $B_{12}$ is produced solely by fermentation, due to the complexity of its synthesis. In vitro methodologies require significant inputs of materials and time, often at great cost C. Purine, Pyrimidine, Nucleoside and Nucleotide Metabolism and Uses Purine and pyrimidine metabolism genes and their corresponding proteins are important targets for the therapy of tumor diseases and viral infections. The language "purine" or "pyrimidine" includes the nitrogenous bases which are constituents of nucleic acids, co-enzymes, and nucleotides. The term "nucleotide" includes the basic structural units of nucleic acid molecules, which are comprised of a nitrogenous base, a pentose sugar (in the case of RNA, the sugar is ribose; in the case of DNA, the sugar is D-deoxyribose), and phosphoric acid. The language "nucleoside" includes molecules which serve as precursors to nucleotides, but which are lacking the phosphoric acid moiety that nucleotides possess. By inhibiting the biosynthesis of these molecules, or their mobilization to form nucleic acid molecules, it is possible to inhibit RNA and DNA synthesis; by inhibiting this activity in a fashion targeted to cancerous cells, the ability of tumor cells to divide and replicate may be inhibited. Additionally, there are nucleotides which do not form nucleic acid molecules, but rather serve as energy stores (i.e., AMP) or as coenzymes (i.e., FAD and NAD).

Several publications have described the use of these chemicals for these medical indications, by influencing purine and/or pyrimidirie metabolism (e.g. Christopherson, R. I. and Lyons, S. D. (1990) "Potent inhibitors of de novo pyrimidine and purine biosynthesis as chemotherapeutic agents." Med Res. Reviews 10: 505–548). Studies of enzymes involved in purine and pyrimidine metabolism have been focused on the development of new drugs which can be used, for example, as immunosuppressants or anti-proliferants (Smith, J. L., (1995) "Enzymes in nucleotide synthesis." Curr. Opin. Struct. Biol. 5: 752–757; (1995) Biochem Soc. Transact. 23: 877–902). However, purine and pyrimidine bases, nucleosides and nucleotides have other utilities: as intermediates in the biosynthesis of several fine chemicals (e.g., thiamine, S-adenosyl-methionine, folates, or riboflavin), as energy carriers for the cell (e.g., ATP or GTP), and for chemicals themselves, commonly used as flavor enhancers (e.g., IMP or GMP) or for several medicinal applications (see, for example, Kuninaka, A. (1996) Nucleotides and Related Compounds in Biotechnology vol. 6, Rehm et al., eds. VCH: Weinheim, p. 561–612). Also, enzymes involved in purine, pyrimidine, nucleoside, or nucleotide metabolism are increasingly serving as targets against which chemicals for crop protection, including fungicides, herbicides and insecticides, are developed.

The metabolism of these compounds in bacteria has been characterized (for reviews see, for example, Zalkin, H. and Dixon, J. E. (1992) "de novo purine nucleotide biosynthesis", in: Progress in Nucleic Acid Research and Molecular Biology, vol. 42, Academic Press:, p. 259–287; and Michal, G. (1999) "Nucleotides and Nucleosides", Chapter 8 in: Biochemical Pathways: An Atlas of Biochemistry and Molecular Biology, Wiley: New York). Purine metabolism has been the subject of intensive research, and is essential to the normal functioning of the cell. Impaired purine metabolism in higher animals can cause severe disease, such as gout. Purine nucleotides are synthesized from ribose-5-phosphate, in a series of steps through the intermediate compound inosine-5'-phosphate (IMP), resulting in the production of guanosine-5'-monophosphate (GMP) or adenosine-5'-monophosphate (AMP), from which the triphosphate forms utilized as nucleotides are readily formed. These compounds are also utilized as energy stores, so their degradation provides energy for many different biochemical processes in the cell. Pyrimidine biosynthesis proceeds by the formation of uridine-5'-monophosphate (UMP) from ribose-5-phosphate. UMP, in turn, is converted to cytidine-5'-triphosphate (CTP). The deoxy-forms of all of these nucleotides are produced in a one step reduction reaction from the diphosphate ribose form of the nucleotide to the diphosphate deoxyribose form of the nucleotide. Upon phosphorylation, these molecules are able to participate in DNA synthesis.

D. Trehalose Metabolism and Uses

Trehalose consists of two glucose molecules, bound in α, α-1,1 linkage. It is commonly used in the food industry as a sweetener, an additive for dried or frozen foods, and in beverages. However, it also has applications in the pharmaceutical, cosmetics and biotechnology industries (see, for example, Nishimoto et al., (1998) U.S. Pat. No. 5,759,610; Singer, M. A. and Lindquist, S. (1998) *Trends Biotech.* 16: 460–467; Paiva, C. L. A. and Panek, A. D. (1996) *Biotech. Ann. Rev.* 2: 293–314; and Shiosaka, M. (1997) *J. Japan* 172: 97–102). Trehalose is produced by enzymes from many microorganisms and is naturally released into the surrounding medium, from which it can be collected using methods known in the art.

II. Resistance to Damage From Chemicals, Environmental Stress, and Antibiotics

Production of fine chemicals is typically performed by large-scale culture of bacteria developed to produce and secrete large quantities of these molecules. However, this type of large-scale fermentation results in the subjection of the microorganisms to stresses of various kinds. These stresses include environmental stress and chemical stress.

A. Resistance to Environmental Stress

Examples of environmental stresses typically encountered in large-scale fermentative culture include mechanical stress, heat stress, stress due to limited oxygen, stress due to oxygen radicals, pH stress, and osmotic stress. The stirring mechanism used in most large-scale fermentors to ensure aeration of the culture produces heat, thus increasing the temperature of the culture. Increases in temperature induce the well-characterized heat shock response, in which a set of proteins are expressed which not only aid in the survival of the bacterium in the face of high temperatures, but also increase survival in response to a number of other environmental stresses (see Neidhardt, F. C., et al, eds. (1996) *E. coli* and Salmonella. ASM Press: Washington, D.C., p. 1382–1399; Wosten, M. M. (1998) *FEMS Microbiology Reviews* 22(3): 127–50; Bahl, H. et al. (1995) *FEMS Microbiology Reviews* 17(3): 341–348; Zimmerman, J. L., Cohill, P. R. (1991) *New Biologist* 3(7): 641–650; Samali, A., and Orrenius, S. (1998) *Cell. Stress Chaperones* 3(4): 228–236, and references contained therein from each of these citations). Regulation of the heat shock response in bacteria is facilitated by specific sigma factors and other cellular regulators of gene expression (Hecker, M., Volker, U (1998). *Molecular Microbiology* 29(5): 1129–1136). One of the largest problems that the cell encounters when exposed to high temperature is that protein folding is impaired; nascent proteins have sufficient kinetic energy in high temperature circumstances that it is difficult for the growing polypeptide chain to remain in a stable conformation long enough to fold properly. Thus, two of the key types of proteins expressed during the heat shock response consist of chaperones (proteins which assist in the folding or unfolding of other proteins—see, e.g., Fink, A. L. (1999) *Physiol. Rev.* 79(2): 425–449), and proteases, which can destroy any improperly folded proteins. Examples of chaperones expressed during the heat shock response include GroEL and DNAK; proteases known to be expressed during this cellular reaction to heat shock include Lon, FtsH, and ClpB.

Other environmental stresses besides heat may also provoke a stress response. Though the fermentor stirring process is meant to introduce oxygen into the culture, oxygen may remain in limited supply, particularly when the culture is advanced in growth and the oxygen needs of the culture are thereby increased; an insufficient supply of oxygen is another stress for the microorganism. Cells in fermentor cultures are also subjected to a number of osmotic stresses, particularly when nutrients are added to the culture, resulting in a high extracellular and low intracellular concentration of these molecules. Further, the large quantities of the desired molecules produced by these organisms in culture may contribute to osmotic stress of the bacteria. Lastly, aerobic metabolism such as that used by *C. glutamicum* results in carbon dioxide as a waste product; secretion of this molecule may acidify the culture medium due to conversion of this molecule to carboxylic acid. Thus, bacteria in culture are also frequently subjected to acidic pH stress. The converse may also be true—when high levels of basic waste molecules such as ammonium are present in the culture medium, the bacteria in culture may be subjected to basic pH stress as well.

To combat such environmental stresses, bacteria have elegant gene systems which are expressed upon exposure to one or more stresses, such as the aforementioned heat shock system. Genes expressed in response to osmotic stress, for example, encode proteins capable of transporting or synthesizing compatible solutes such that osmotic intake or export of a particular molecule is slowed to manageable levels. Other examples of stress-induced bacterial proteins are those involved in trehalose biosynthesis, those encoding enzymes involved in ppGpp metabolism, those involved in signal transduction, particularly those encoding two-component systems which are sensitive to osmotic pressure, and those encoding transcription factors which are responsive to a variety of stress factors (e.g., RssB analogues and/or sigma factors). Many other such genes and their protein products are known in the art.

B. Resistance to Chemical Stress

Aside from environmental stresses, cells may also experience a number of chemical stresses. These may fall into two categories. The first are natural waste products of metabolism and other cellular processes which are secreted by the cell to the surrounding medium. The second are chemicals present in the extracellular medium which do not originate from the cell. Generally, when cells excrete toxic waste products from the concentrated intracellular cytoplasm into the relatively much more dilute extracellular medium, these products dissipate such that extracellular levels of the possibly toxic compound are quite low. However, in large-scale fermentative culture of the bacterium, this may not be the case: so many bacteria are grown in a relatively small environment and at such a high metabolic rate that waste products may accumulate in the medium to nearly toxic levels. Examples of such wastes are carbon dioxide, metal ions, and reactive oxygen species such as hydrogen peroxide. These compounds may interfere with the activity or structure of cell surface molecules, or may re-enter the cell, where they can seriously damage proteins and nucleic acids alike. Certain other chemicals hazardous to the normal functioning of cells may be naturally found in the extracellular medium. For example, metal ions such as mercury, cadmium, nickel or copper are frequently found in water sources, and may form tight complexes with cellular enzymes which prevent the normal functioning of these proteins.

C. Resistance to Antibiotics

Bacteriocidal proteins or antibiotics, may also be found in the extracellular milieu, either through the intervention of the researcher, or as a natural product from another organism, utilized to gain a competitive advantage. Microorganisms have several art-known mechanisms to protect themselves against antimicrobial chemicals. Degradation, modification, and export of compounds toxic to the cell are common methods by which microorganisms eliminate or detoxify antibiotics. Cytoplasmic 'efflux-pumps' are known in several prokaryotes and show similarities to the so-called 'multidrug resistance' proteins from higher eukaryotes (Neyfakh, A. A., et al. (1991) Proc. Natl. Acad Sci. USA 88: 4781–4785). Examples of such proteins include emrAB from E. coli (Lomovskaya, O. and K. Lewis (1992) Proc. Natl. Acad. Sci. USA 89: 8938–8942), lmrB from B. subtilis (Kunano, M. et al. (1997) Microbiology 143: 2775–2782), smr from S. aureus (Grinius, L. G. et al. (1992) Plasmid 27: 119–129) or cmr from C. glutamicum (Kaidoh, K. et al. (1997) Micro. Drug Resist. 3: 345–350). C. glutamicum itself is non-pathogenic, in contrast to several other members of the genus Corynebacterium, such as C. diphtheriae or C. pseudotuberculosis. Several pathogenic Corynebacteria are known to have multiple resistances against a variety of antibiotics, such as C. jeikeium and C. urealyticum (Soriano, F. et al. (1995) Antimicrob. Agents Chemother. 39: 208–214).

Lincosamides are recognized as effective antibiotics against Corynebacterium species (Soriano, F. et al. (1995) Antimicrob. Agents Chemother. 39: 208–214). An unexpected result of the present invention was the identification of a gene encoding a lincosamide-resistance protein (in particular, a lincomycin-resistance protein). The LMRB protein from C. glutamicum shows 40% homology to the product of the lmrB gene from B. subtilis (see Genbank accession no. AL009126), as calculated using version 1.7 of the program CLUSTALW (Thompson, J. D., Higgins, D. G., Gibson, T. J. (1994) Nucl. Acids Res. 22: 4673–4680) using standard parameters (PAIRWISE ALIGNMENT PARAMETERS: slow/accurate alignments: Gap Open Penalty= 10.00, Gap Extension Penalty=0.10, Protein weight matrix= BLOSUM 30, DNA weight matrix=IUB, Fast/Approximate alignments: Gap penalty=3, K-tuple (word) size=1, No. of top diagonals=5, Window size=5, Toggle Slow/Fast pairwise alignments=slow. Multiple alignment parameters: Gap Opening Penalty=10.00, Gap Extension Penalty=0.05, Delay divergent sequences=40%, DNA transitions weight= 0.50, Protein weight matrix=BLOSUM series, DNA weight matrix=IUB, Use negative matrix=OFF).

Environmental stress, chemical stress, and antibiotic or other antimicrobial stress may influence the behavior of the microorganisms during fermentor culture, and may have an impact on the production of the desired compound from these organisms. For example, osmotic stress of a microorganism may cause inappropriate or inappropriately rapid uptake of one or more compounds which can ultimately lead to cellular damage or death due to osmotic shock. Similarly, chemicals present in the culture, either exogenously added (e.g., antimicrobial compounds intended to eliminate unwanted microbes) or generated by the bacteria themselves (e.g., waste compounds such as heavy metals or oxygen radicals, or even antimicrobial compounds) may result in inhibition of fine chemical production or even death of the organism. The genes of the invention encode C. glutamicum proteins which act to prevent cell damage or death, by specifically counteracting the source or effect of the environmental or chemical stress.

III. Elements and Methods of the Invention

The present invention is based, at least in part, on the discovery of novel molecules, referred to herein as SRT nucleic acid and protein molecules, which increase the ability of C. glutamicum to survive in chemically or environmentally hazardous settings. In one embodiment, the SRT molecules function to confer resistance to one or more environmental or chemical stresses to C. glutamicum. In a preferred embodiment, the activity of the SRT molecules of the present invention has an impact on the production of a desired fine chemical by this organism. In a particularly preferred embodiment, the SRT molecules of the invention are modulated in activity, such that the yield, production, and/or efficiency of production of one or more fine chemicals from C. glutamicum is also modulated.

The language, "SRT protein" or "SRT polypeptide" includes proteins which participate in the resistance of C. glutamicum to one or more environmental or chemical stresses. Examples of SRT proteins include those encoded by the SRT genes set forth in Table 1 and Appendix A. The terms "SRT gene" or "SRT nucleic acid sequence" include nucleic acid sequences encoding an SRT protein, which consist of a coding region and also corresponding untranslated 5' and 3' sequence regions. Examples of SRT genes include those set forth in Table 1. The terms "production" or "productivity" are art-recognized and include the concentration of the fermentation product (for example, the desired fine chemical) formed within a given time and a given fermentation volume (e.g., kg product per hour per liter). The term "efficiency of production" includes the time required for a particular level of production to be achieved (for example, how long it takes for the cell to attain a particular rate of output of a fine chemical). The term "yield" or "product/carbon yield" is art-recognized and includes the efficiency of the conversion of the carbon source into the product (i.e., fine chemical). This is generally written as, for example, kg product per kg carbon source. By increasing the yield or production of the compound, the quantity of recovered molecules, or of useful recovered molecules of that compound in a given amount of culture over a given amount of time is increased. The terms "biosynthesis" or a "biosynthetic pathway" are art-recognized and include the synthesis of a compound, preferably an organic compound, by a cell from intermediate compounds in what may be a multistep and highly regulated process. The terms "degradation" or a "degradation pathway" are art-recognized and include the breakdown of a compound, preferably an organic compound, by a cell to degradation products (generally speaking, smaller or less complex molecules) in what may be a multistep and highly regulated process. The language "metabolism" is art-recognized and includes the totality of the biochemical reactions that take place in an organism. The metabolism of a particular compound, then, (e.g., the metabolism of an amino acid such as glycine) comprises the overall biosynthetic, modification, and degradation pathways in the cell related to this compound. The terms "resistance" and "tolerance" are art-known and include the ability of a cell to not be affected by exposure to a chemical or an environment which would otherwise be detrimental to the normal functioning of these organisms. The terms "stress" or "hazard" include factors which are detrimental to the normal functioning of cells such as C. glutamicum. Examples of stresses include "chemical stress", in which a cell is exposed to one or more chemicals which are detrimental to the cell, and "environmental stress" where a cell is exposed to an environmental condition outside of those to which it is adapted. Chemical stresses may be either natural metabolic waste products such as, but not limited to reactive oxygen species or carbon dioxide, or chemicals otherwise present in the environment, including, but not limited to heavy metal ions or bacteriocidal proteins such as antibiotics. Environmental stresses may be, but are not limited to temperatures outside of the normal range, suboptimal oxygen availability, osmotic pressures, or extremes of pH, for example.

In another embodiment, the SRT molecules of the invention are capable of modulating the production of a desired molecule, such as a fine chemical, in a microorganism such as *C. glutamicum*. Using recombinant genetic techniques, one or more of the SRT proteins of the invention may be manipulated such that its function is modulated. The alteration of activity of stress response, resistance or tolerance genes such that the cell is increased in tolerance to one or more stresses may improve the ability of that cell to grow and multiply in the relatively stressful conditions of large-scale fermentor culture. For example, by overexpressing or engineering a heat-shock induced chaperone molecule such that it is optimized in activity, one may increase the ability of the bacterium to correctly fold proteins in the face of nonoptimal temperature conditions. By having fewer misfolded (and possibly misregulated or nonfunctional) proteins, the cell is increased in its ability to function normally in such a culture, which should in turn provide increased viability. This overall increase in number of cells having greater viability and activity in the culture should also result in an increase in the yield, production, and/or efficiency of production of one or more desired fine chemicals, due at least to the relatively greater number of cells producing these chemicals in the culture.

The isolated nucleic acid sequences of the invention are contained within the genome of a *Corynebacterium glutamicum* strain available through the American Type Culture Collection, given designation ATCC 13032. The nucleotide sequence of the isolated *C. glutamicum* SRT DNAs and the predicted amino acid sequences of the *C. glutamicum* SRT proteins are shown in Appendices A and B, respectively. Computational analyses were performed which classified and/or identified these nucleotide sequences as sequences which encode chemical and environmental stress, resistance, and tolerance proteins.

The present invention also pertains to proteins which have an amino acid sequence which is substantially homologous to an amino acid sequence of Appendix B. As used herein, a protein which has an amino acid sequence which is substantially homologous to a selected amino acid sequence is least about 50% homologous to the selected amino acid sequence, e.g., the entire selected amino acid sequence. A protein which has an amino acid sequence which is substantially homologous to a selected amino acid sequence can also be least about 50–60%, preferably at least about 60–70%, and more preferably at least about 70–80%, 80–90%, or 90–95%, and most preferably at least about 96%, 97%, 98%, 99% or more homologous to the selected amino acid sequence. Ranges and identity values intermediate to the above-recited values, (e.g., 75%–80% identical, 85–87% identical, 91–92% identical) are also intended to be encompassed by the present invention. For example, ranges of identity values using a combination of any of the above values recited as upper and/or lower limits are intended to be included.

The SRT proteins or biologically active portions or fragments thereof of the invention can confer resistance or tolerance to one or more chemical or environmental stresses, or may have one or more of the activities set forth in Table 1.

Various aspects of the invention are described in further detail in the following subsections:

A. Isolated Nucleic Acid Molecules

One aspect of the invention pertains to isolated nucleic acid molecules that encode SRT polypeptides or biologically active portions thereof, as well as nucleic acid fragments sufficient for use as hybridization probes or primers for the identification or amplification of SRT-encoding nucleic acid (e.g., SRT DNA). As used herein, the term "nucleic acid molecule" is intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of the gene: at least about 100 nucleotides of sequence upstream from the 5' end of the coding region and at least about 20 nucleotides of sequence downstream from the 3'end of the coding region of the gene. The nucleic acid molecule can be single-stranded or double-stranded, but preferably is double-stranded DNA. An "isolated" nucleic acid molecule is one which is separated from other nucleic acid molecules which are present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. For example, in various embodiments, the isolated SRT nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived (e.g, a *C. glutamicum* cell). Moreover, an "isolated" nucleic acid molecule, such as a DNA molecule, can be substantially free of other cellular material, or culture medium when produced by recombinant techniques, or chemical precursors or other chemicals when chemically synthesized.

A nucleic acid molecule of the present invention, e.g., a nucleic acid molecule having a nucleotide sequence of Appendix A, or a portion thereof, can be isolated using standard molecular biology techniques and the sequence information provided herein. For example, a *C. glutamicum* SRT DNA can be isolated from a *C. glutamicum* library using all or portion of one of the sequences of Appendix A as a hybridization probe and standard hybridization techniques (e.g, as described in Sambrook, J., Fritsh, E. F., and Maniatis, T. *Molecular Cloning: A Laboratory Manual.* 2nd, ed, Cold Spring Harbor Laboratory, Cold Spring Harbor Laboratory Press, Cold Spring Harbor, N.Y., 1989). Moreover, a nucleic acid molecule encompassing all or a portion of one of the sequences of Appendix A can be isolated by the polymerase chain reaction using oligonucleotide primers designed based upon this sequence (e.g., a nucleic acid molecule encompassing all or a portion of one of the sequences of Appendix A can be isolated by the polymerase chain reaction using oligonucleotide primers designed based upon this same sequence of Appendix A). For example, mRNA can be isolated from normal endothelial cells (e.g., by the guanidinium-thiocyanate extraction procedure of Chirgwin et al. (1979) *Biochemistry* 18: 5294–5299) and DNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the nucleotide sequences shown in Appendix A. A nucleic acid of the invention can be amplified using cDNA or, alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to an SRT nucleotide sequence can be prepared by standard synthetic techniques, e.g., using an automated DNA synthesizer.

In a preferred embodiment, an isolated nucleic acid molecule of the invention comprises one of the nucleotide sequences shown in Appendix A. The sequences of Appendix A correspond to the *Corynebacterium glutamicum* SRT DNAs of the invention. This DNA comprises sequences encoding SRT proteins (i.e., the "coding region", indicated in each sequence in Appendix A), as well as 5' untranslated sequences and 3' untranslated sequences, also indicated in Appendix A. Alternatively, the nucleic acid molecule can comprise only the coding region of any of the sequences in Appendix A.

For the purposes of this application, it will be understood that each of the sequences set forth in Appendix A has an identifying RXA, RXN, or RXSnumber having the designation "RXA", "RXN", or "RXS" followed by 5 digits (i e., RXA01524, RXN00493, or RXS01027). Each of these sequences comprises up to three parts: a 5' upstream region, a coding region, and a downstream region. Each of these three regions is identified by the same RXA, RXN, or RXS designation to eliminate confusion. The recitation "one of the sequences in Appendix A", then, refers to any of the sequences in Appendix A, which may be distinguished by their differing RXA, RXN, or RXS designations. The coding region of each of these sequences is translated into a corresponding amino acid sequence, which is set forth in Appendix B. The sequences of Appendix B are identified by the same RXA, RXN, or RXS designations as Appendix A, such that they can be readily correlated. For example, the amino acid sequence in Appendix B designated RXA01524 is a translation of the coding region of the nucleotide sequence of nucleic acid molecule RXA01524 in Appendix A, the amino acid sequence in Appendix B designated RXN00034 is a translation of the coding region of the nucleotide sequence of nucleic acid molecule RXN0034 in Appendix A, and the amino acid sequence in Appendix B designated RXS00568 is a translation of the coding region of the nucleotide sequence of nucleic acid molecule RXS00568 in Appendix A. Each of the RXA, RXN, and RXS nucleotide and amino acid sequences of the invention has also been assigned a SEQ ID NO, as indicated in Table 1.

Several of the genes of the invention are "F-designated genes". An F-designated gene includes those genes set forth in Table 1 which have an 'F' in front of the RXA, RXN, or RXS designation. For example, SEQ ID NO:7, designated, as indicated on Table 1, as "F RXA00498", is an F-designated gene, as are SEQ ID NOs: 25, 33, and 37 (designated on Table 1 as "F RXA01345", "F RXA02543", and "F RXA02282", respectively).

In one embodiment, the nucleic acid molecules of the present invention are not intended to include those compiled in Table 2. In the case of the dapD gene, a sequence for this gene was published in Wehrmann, A., et aL (1998) *J. Bacteriol.* 180(12): 3159–3165. However, the sequence obtained by the inventors of the present application is significantly longer than the published version. It is believed that the published version relied on an incorrect start codon, and thus represents only a fragment of the actual coding region.

In another preferred embodiment, an isolated nucleic acid molecule of the invention comprises a nucleic acid molecule which is a complement of one of the nucleotide sequences shown in Appendix A, or a portion thereof A nucleic acid molecule which is complementary to one of the nucleotide sequences shown in Appendix A is one which is sufficiently complementary to one of the nucleotide sequences shown in Appendix A such that it can hybridize to one of the nucleotide sequences shown in Appendix A, thereby forming a stable duplex.

In still another preferred embodiment, an isolated nucleic acid molecule of the invention comprises a nucleotide sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to a nucleotide sequence shown in Appendix A, or a portion thereof. Ranges and identity values intermediate to the above-recited ranges, (e.g., 70–90% identical or 80–95% identical) are also intended to be encompassed by the present invention. For example, ranges of identity values using a combination of any of the above values recited as upper and/or lower limits are intended to be included. In an additional preferred embodiment, an isolated nucleic acid molecule of the invention comprises a nucleotide sequence which hybridizes, e.g., hybridizes under stringent conditions, to one of the nucleotide sequences shown in Appendix A, or a portion thereof.

Moreover, the nucleic acid molecule of the invention can comprise only a portion of the coding region of one of the sequences in Appendix A, for example a fragment which can be used as a probe or primer or a fragment encoding a biologically active portion of an SRT protein. The nucleotide sequences determined from the cloning of the SRT genes from *C. glutamicum* allows for the generation of probes and primers designed for use in identifying and/or cloning SRT homologues in other cell types and organisms, as well as SRT homologues from other Corynebacteria or related species. The probe/primer typically comprises substantially purified oligonucleotide. The oligonucleotide typically comprises a region of nucleotide sequence that hybridizes under stringent conditions to at least about 12, preferably about 25, more preferably about 40, 50 or 75 consecutive nucleotides of a sense strand of one of the sequences set forth in Appendix A, an anti-sense sequence of one of the sequences set forth in Appendix A, or naturally occurring mutants thereof. Primers based on a nucleotide sequence of Appendix A can be used in PCR reactions to clone SRT homologues. Probes based on the SRT nucleotide sequences can be used to detect transcripts or genomic sequences encoding the same or homologous proteins. In preferred embodiments, the probe further comprises a label group attached thereto, e.g. the label group can be a radioisotope, a fluorescent compound, an enzyme, or an enzyme co-factor. Such probes can be used as a part of a diagnostic test kit for identifying cells which misexpress an SRT protein, such as by measuring a level of an SRT-encoding nucleic acid in a sample of cells, e.g., detecting SRT mRNA levels or determining whether a genomic SRT gene has been mutated or deleted.

In one embodiment, the nucleic acid molecule of the invention encodes a protein or portion thereof which includes an amino acid sequence which is sufficiently homologous to an amino acid sequence of Appendix B such that the protein or portion thereof maintains the ability to confer resistance or tolerance of *C. glutamicum* to one or more chemical or environmental stresses. As used herein, the language "sufficiently homologous" refers to proteins or portions thereof which have amino acid sequences which include a minimum number of identical or equivalent (e.g., an amino acid residue which has a similar side chain as an amino acid residue in one of the sequences of Appendix B) amino acid residues to an amino acid sequence of Appendix B such that the protein or portion thereof is capable of participating in the resistance of *C. glutamicum* to one or more chemical or environmental stresses. Protein members of such metabolic pathways, as described herein, function to increase the resistance or tolerance of *C. glutamicum* to one or more environmental or chemical hazards or stresses. Examples of such activities are also described herein. Thus, "the function of an SRT protein" contributes to the overall resistance of *C. glutamicum* to elements of its surroundings which may impede its normal growth or functioning, and/or contributes, either directly or indirectly, to the yield, production, and/or efficiency of production of one or more fine chemicals. Examples of SRT protein activities are set forth in Table 1.

In another embodiment, the protein is at least about 50–60%, preferably at least about 60–70%, and more preferably at least about 70–80%, 80–90%, 90–95%, and most preferably at least about 96%, 97%, 98%, 99% or more homologous to an entire amino acid sequence of Appendix B. Ranges and identity values intermediate to the above-recited values, (e.g., 75%–80% identical, 85–87% identical, or 91–92% identical) are also intended to be encompassed by the present invention. For example, ranges of identity values using a combination of any of the above values recited as upper and/or lower limits are intended to be included.

Portions of proteins encoded by the SRT nucleic acid molecules of the invention are preferably biologically active portions of one of the SRT proteins. As used herein, the term "biologically active portion of an SRT protein" is intended to include a portion, e.g., a domain/motif, of an SRT protein that is capable of imparting resistance or tolerance to one or more environmental or chemical stresses or hazards, or has an activity as set forth in Table 1. To determine whether an SRT protein or a biologically active portion thereof can increase the resistance or tolerance of *C. glutamicum* to one or more chemical or environmental stresses or hazards, an assay of enzymatic activity may be performed. Such assay methods are well known to those of ordinary skill in the art, as detailed in Example 8 of the Exemplification.

Additional nucleic acid fragments encoding biologically active portions of an SRT protein can be prepared by isolating a portion of one of the sequences in Appendix B, expressing the encoded portion of the SRT protein or peptide (e.g., by recombinant expression in vitro) and assessing the activity of the encoded portion of the SRT protein or peptide.

The invention further encompasses nucleic acid molecules that differ from one of the nucleotide sequences shown in Appendix A (and portions thereof) due to degeneracy of the genetic code and thus encode the same SRT protein as that encoded by the nucleotide sequences shown in Appendix A. In another embodiment, an isolated nucleic acid molecule of the invention has a nucleotide sequence encoding a protein having an amino acid sequence shown in Appendix B. In a still further embodiment, the nucleic acid molecule of the invention encodes a full length *C. glutamicum* protein which is substantially homologous to an amino acid sequence of Appendix B (encoded by an open reading frame shown in Appendix A).

It will be understood by one of ordinary skill in the art that in one embodiment the sequences of the invention are not meant to include the sequences of the prior art, such as those Genbank sequences set forth in Tables 2 or 4 which were available prior to the present invention. In one embodiment, the invention includes nucleotide and amino acid sequences having a percent identity to a nucleotide or amino acid sequence of the invention which is greater than that of a sequence of the prior art (e.g., a Genbank sequence (or the protein encoded by such a sequence) set forth in Tables 2 or 4). For example, the invention includes a nucleotide sequence which is greater than and/or at least 39% identical to the nucleotide sequence designated RXA00084 (SEQ ID NO: 189), a nucleotide sequence which is greater than and/or at least 56% identical to the nucleotide sequence designated RXA00605 (SEQ ID NO: 11), and a nucleotide sequence which is greater than and/or at least 50% identical to the nucleotide sequence designated RXA00886 (SEQ ID NO:39). One of ordinary skill in the art would be able to calculate the lower threshold of percent identity for any given sequence of the invention by examining the GAP-calculated percent identity scores set forth in Table 4 for each of the three top hits for the given sequence, and by subtracting the highest GAP-calculated percent identity from 100 percent. One of ordinary skill in the art will also appreciate that nucleic acid and amino acid sequences having percent identities greater than the lower threshold so calculated (e.g., at least 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more identical) are also encompassed by the invention.

In addition to the *C. glutamicum* SRT nucleotide sequences shown in Appendix A, it will be appreciated by one of ordinary skill in the art that DNA sequence polymorphisms that lead to changes in the amino acid sequences of SRT proteins may exist within a population (e.g., the *C. glutamicum* population). Such genetic polymorphism in the SRT gene may exist among individuals within a population due to natural variation. As used herein, the terms "gene" and "recombinant gene" refer to nucleic acid molecules comprising an open reading frame encoding an SRT protein, preferably a *C. glutamicum* SRT protein. Such natural variations can typically result in 1–5% variance in the nucleotide sequence of the SRT gene. Any and all such nucleotide variations and resulting amino acid polymorphisms in SRT that are the result of natural variation and that do not alter the functional activity of SRT proteins are intended to be within the scope of the invention.

Nucleic acid molecules corresponding to natural variants and non-*C. glutamicum* homologues of the *C. glutamicum* SRT DNA of the invention can be isolated based on their homology to the *C. glutamicum* SRT nucleic acid disclosed herein using the *C. glutamicum* DNA, or a portion thereof, as a hybridization probe according to standard hybridization techniques under stringent hybridization conditions. Accordingly, in another embodiment, an isolated nucleic acid molecule of the invention is at least 15 nucleotides in length and hybridizes under stringent conditions to the nucleic acid molecule comprising a nucleotide sequence of Appendix A. In other embodiments, the nucleic acid is at least 30, 50, 100, 250 or more nucleotides in length. As used herein, the term "hybridizes under stringent conditions" is intended to describe conditions for hybridization and washing under which nucleotide sequences at least 60% homologous to each other typically remain hybridized to each other. Preferably, the conditions are such that sequences at least about 65%, more preferably at least about 70%, and even more preferably at least about 75% or more homologous to each other typically remain hybridized to each other. Such stringent conditions are known to those of ordinary skill in the art in the art and can be found in Ausubel et al., *Current Protocols in Molecular Biology*, John Wiley & Sons, N.Y. (1989), 6.3.1–6.3.6. A preferred, non-limiting example of stringent hybridization conditions are hybridization in 6× sodium chloride/sodium citrate (SSC) at about 45° C., followed by one or more washes in 0.2×SSC, 0.1% SDS at 50–65° C. Preferably, an isolated nucleic acid molecule of the invention that hybridizes under stringent conditions to a sequence of Appendix A corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein). In one embodiment, the nucleic acid encodes a natural *C. glutamicum* SRT protein.

In addition to naturally-occurring variants of the SRT sequence that may exist in the population, one of ordinary skill in the art will further appreciate that changes can be introduced by mutation into a nucleotide sequence of Appendix A, thereby leading to changes in the amino acid sequence of the encoded SRT protein, without altering the functional ability of the SRT protein. For example, nucleotide substitutions leading to amino acid substitutions at "non-essential" amino acid residues can be made in a sequence of Appendix A. A "non-essential" amino acid residue is a residue that can be altered from the wild-type sequence of one of the SRT proteins (Appendix B) without altering the activity of said SRT protein, whereas an "essential" amino acid residue is required for SRT protein activity. Other amino acid residues, however, (e.g., those that are not conserved or only semi-conserved in the domain having SRT activity) may not be essential for activity and thus are likely to be amenable to alteration without altering SRT activity.

Accordingly, another aspect of the invention pertains to nucleic acid molecules encoding SRT proteins that contain changes in amino acid residues that are not essential for SRT activity. Such SRT proteins differ in amino acid sequence from a sequence contained in Appendix B yet retain at least one of the SRT activities described herein. In one embodiment, the isolated nucleic acid molecule comprises a nucleotide sequence encoding a protein, wherein the protein comprises an amino acid sequence at least about 50% homologous to an amino acid sequence of Appendix B and is capable of increasing the resistance or tolerance of *C. glutamicum* to one or more environmental or chemical stresses, or has one or more of the activities set forth in Table 1. Preferably, the protein encoded by the nucleic acid molecule is at least about 50–60% homologous to one of the sequences in Appendix B, more preferably at least about 60–70% homologous to one of the sequences in Appendix B, even more preferably at least about 70–80%, 80–90%, 90–95% homologous to one of the sequences in Appendix B, and most preferably at least about 96%, 97%, 98%, or 99% homologous to one of the sequences in Appendix B.

To determine the percent homology of two amino acid sequences (e.g., one of the sequences of Appendix B and a mutant form thereof) or of two nucleic acids, the sequences are aligned for optimal comparison purposes (e.g., gaps can be introduced in the sequence of one protein or nucleic acid for optimal alignment with the other protein or nucleic acid). The amino acid residues or nucleotides at corresponding amino acid positions or nucleotide positions are then compared. When a position in one sequence (e.g., one of the sequences of Appendix B) is occupied by the same amino acid residue or nucleotide as the corresponding position in the other sequence (e.g., a mutant form of the sequence selected from Appendix B), then the molecules are homologous at that position (i.e., as used herein amino acid or nucleic acid "homology" is equivalent to amino acid or nucleic acid "identity"). The percent homology between the two sequences is a function of the number of identical positions shared by the sequences (i.e., % homology=# of identical positions/total # of positions×100).

An isolated nucleic acid molecule encoding an SRT protein homologous to a protein sequence of Appendix B can be created by introducing one or more nucleotide substitutions, additions or deletions into a nucleotide sequence of Appendix A such that one or more amino acid substitutions, additions or deletions are introduced into the encoded protein. Mutations can be introduced into one of the sequences of Appendix A by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in an SRT protein is preferably replaced with another amino acid residue from the same side chain family. Alternatively, in another embodiment, mutations can be introduced randomly along all or part of an SRT coding sequence, such as by saturation mutagenesis, and the resultant mutants can be screened for an SRT activity described herein to identify mutants that retain SRT activity. Following mutagenesis of one of the sequences of Appendix A, the encoded protein can be expressed recombinantly and the activity of the protein can be determined using, for example, assays described herein (see Example 8 of the Exemplification).

In addition to the nucleic acid molecules encoding SRT proteins described above, another aspect of the invention pertains to isolated nucleic acid molecules which are antisense thereto. An "antisense" nucleic acid comprises a nucleotide sequence which is complementary to a "sense" nucleic acid encoding a protein, e.g., complementary to the coding strand of a double-stranded DNA molecule or complementary to an mRNA sequence. Accordingly, an antisense nucleic acid can hydrogen bond to a sense nucleic acid. The antisense nucleic acid can be complementary to an entire SRT coding strand, or to only a portion thereof. In one embodiment, an antisense nucleic acid molecule is antisense to a "coding region" of the coding strand of a nucleotide sequence encoding an SRT protein. The term "coding region" refers to the region of the nucleotide sequence comprising codons which are translated into amino acid residues (e.g., the entire coding region of SEQ ID NO.: 120 (RXA00600) comprises nucleotides 1 to 1098). In another embodiment, the antisense nucleic acid molecule is antisense to a "noncoding region" of the coding strand of a nucleotide sequence encoding SRT. The term "noncoding region" refers to 5' and 3' sequences which flank the coding region that are not translated into amino acids (i.e., also referred to as 5' and 3' untranslated regions).

Given the coding strand sequences encoding SRT disclosed herein (e.g., the sequences set forth in Appendix A), antisense nucleic acids of the invention can be designed according to the rules of Watson and Crick base pairing. The antisense nucleic acid molecule can be complementary to the entire coding region of SRT mRNA, but more preferably is an oligonucleotide which is antisense to only a portion of the coding or noncoding region of SRT mRNA. For example, the antisense oligonucleotide can be complementary to the region surrounding the translation start site of SRT mRNA. An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a cell or generated in situ such that they hybridize with or bind to cellular mRNA and/or genomic DNA encoding an SRT protein to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids. Res.* 15:6625–6641). The antisense nucleic acid molecule can also comprise a 2'-o-methylribonucleotide (Inoue et al. (1987) *NucleicAcids Res.* 15:6131–6148) or a chimeric RNA-DNA analogue (Inoue et al. (1987) *FEBS Lett.* 215:327–330).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585–591)) can be used to catalytically cleave SRT mRNA transcripts to thereby inhibit translation of SRT mRNA. A ribozyme having specificity for an SRT-encoding nucleic acid can be designed based upon the nuclcotide sequence of an SRT cDNA disclosed herein (i.e., SEQ ID NO:119 (RXA00600 in Appendix A)). For example, a derivative of a Tetrahymena L-19 IVS RNA can be constructed in which the nucleotide sequence of the active site is complementary to the nucleotide sequence to be cleaved in an SRT-encoding mRNA. See, e.g., Cech et al. U.S. Pat. No. 4,987,071 and Cech et al. U.S. Pat. No. 5,116,742. Alternatively, SRT mRNA can be used to select a catalytic RNA having a specific ribonuclease activity from a pool of RNA molecules. See, e.g., Bartel, D. and Szostak, J. W. (1993) *Science* 261:1411–1418.

Alternatively, SRT gene expression can be inhibited by targeting nucleotide sequences complementary to the regulatory region of an SRT nucleotide sequence (e.g., an SRT promoter and/or enhancers) to form triple helical structures that prevent transcription of an SRT gene in target cells. See generally, Helene, C. (1991) *Anticancer Drug Des.* 6(6):569–84; Helene, C. et al. (1992) *Ann. N.Y. Acad Sci.* 660:27–36; and Maher, L. J. (1992) *Bioassays* 14(12):807–15.

B. Recombinant Expression Vectors and Host Cells

Another aspect of the invention pertains to vectors, preferably expression vectors, containing a nucleic acid encoding an SRT protein (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel; *Gene Expression Technology: Methods in Enzymology* 185, Academic Press, San Diego, Calif. (1990). Regulatory sequences include those which direct constitutive expression of a nucleotide sequence in many types of host cell and those which direct expression of the nucleotide sequence only in certain host cells. Preferred regulatory sequences are, for example, promoters such as cos-, tac-, trp-, tet-, trp-tet-, lpp-, lac-, lpp-lac-, lacI$^q$-, T7-, T5-, T3-, gal-, trc-, ara-, SP6-, amy, SPO2, $\lambda$-P$_R$- or $\lambda$P$_L$, which are used preferably in bacteria. Additional regulatory sequences are, for example, promoters from yeasts and fungi, such as ADC1, MF$\alpha$, AC, P-60, CYC1, GAPDH, TEF, rp28, ADH, promoters from plants such as CaMV/35S, SSU, OCS, lib4, usp, STLS1, B33, nos or ubiquitin- or phaseolin-promoters. It is also possible to use artificial promoters. It will be appreciated by one of ordinary skill in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., SRT proteins, mutant forms of SRT proteins, fusion proteins, etc.).

The recombinant expression vectors of the invention can be designed for expression of SRT proteins in prokaryotic or eukaryotic cells. For example, SRT genes can be expressed in bacterial cells such as *C. glutamicum*, insect cells (using baculovirus expression vectors), yeast and other fungal cells (see Romanos, M. A. et al (1992) "Foreign gene expression in yeast: a review", Yeast 8: 423–488; van den Hondel, C. A. M. J. J. et al. (1991) "Heterologous gene expression in filamentous fungi" in: More Gene Manipulations in Fungi, J. W. Bennet & L. L. Lasure, eds., p. 396–428: Academic Press: San Diego; and van den Hondel, C. A. M. J. J. & Punt, P. J. (1991) "Gene transfer systems and vector development for filamentous fungi, in: Applied Molecular Genetics of Fungi, Peberdy, J. F. et al., eds., p. 1–28, Cambridge University Press: Cambridge), algae and multicellular plant cells (see Schmidt, R and Willmitzer, L. (1988) High efficiency *Agrobacterium tumefaciens*—mediated transformation of *Arabidopsis thaliana* leaf and cotyledon explants" *Plant Cell Rep.*: 583–586), or mammalian cells. Suitable host cells are discussed further in Goeddel, *Gene Expression Technology: Methods in Enzymology* 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase.

Typical fusion expression vectors include pGEX (Pharmacia Biotech Inc; Smith, D. B. and Johnson, K. S. (1988) *Gene* 67:31–40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. In one embodiment, the coding sequence of the SRT protein is cloned into a pGEX expression vector to create a vector encoding a fusion protein comprising, from the N-terminus to the C-terminus, GST-thrombin cleavage site-X protein. The fusion protein can be purified by affinity chromatography using glutathione-agarose resin. Recombinant SRT protein unfused to GST can be recovered by cleavage of the fusion protein with thrombin.

Examples of suitable inducible non-fusion *E. coli* expression vectors include pTrc (Amann et al., (1988) *Gene* 69:301–315) pLG338, pACYC184, pBR322, pUC18, pUC19, pKC30, pRep4, pHS1, pHS2, pPLc236, pMBL24, pLG200, pUR290, pIN-III113-B1, $\lambda$gt11, pBdC1, and pET11d (Studier et al, *Gene Expression Technology: Methods in Enzymology* 185, Academic Press, San Diego, Calif. (1990) 60–89; and Pouwels et al., eds. (1985) Cloning Vectors. Elsevier: New York IBSN 0 444 904018). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174(DE3) from a resident $\lambda$ prophage harboring a T7 gn1 gene under the transcriptional control of the lacUV 5 promoter. For transformation of other varieties of bacteria, appropriate vectors may be selected. For example, the plasmids pIJ101, pIJ364, pIJ702 and pIJ361 are known to be useful in transforming Streptomyces, while plasmids pUB110, pC194, or pBD214 are suited for transformation of Bacillus species. Several plasmids of use in the transfer of genetic information into Corynebacterium include pHM1519, pBL1, pSA77, or pAJ667 (Pouwels et al., eds. (1985) Cloning Vectors. Elsevier: New York IBSN 0 444 904018).

One strategy to maximize recombinant protein expression is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy is to alter the nucleic acid sequence of the nucleic acid to be inserted into an expression vector so that the individual codons for each amino acid are those preferentially utilized in the bacterium chosen for expression, such as *C. glutamicum* (Wada et al. (1992) *Nucleic Acids Res.* 20:2111–2118). Such alteration of nucleic acid sequences of the invention can be carried out by standard DNA synthesis techniques.

In another embodiment, the SRT protein expression vector is a yeast expression vector. Examples of vectors for expression in yeast *S. cerevisiae* include pYepSec1 (Baldari, et al., (1987) *Embo J.* 6:229–234), 2 μ, pAG-1, Yep6, Yep13, pEMBLYe23, pMFa (Kurjan and Herskowitz, (1982) *Cell* 30:933–943), pJRY88 (Schultz et al., (1987) *Gene* 54:113–123), and pYES2 (Invitrogen Corporation, San Diego, Calif.). Vectors and methods for the construction of vectors appropriate for use in other fungi, such as the filamentous fungi, include those detailed in: van den Hondel, C. A. M. J. J. & Punt, P. J. (1991) "Gene transfer systems and vector development for filamentous fungi, in: Applied Molecular Genetics of Fungi, J. F. Peberdy, et al., eds., p. 1–28, Cambridge University Press: Cambridge, and Pouwels et al., eds. (1985) Cloning Vectors. Elsevier: New York (IBSN 0 444 904018).

Alternatively, the SRT proteins of the invention can be expressed in insect cells using baculovirus expression vectors. Baculovirus vectors available for expression of proteins in cultured insect cells (e.g., Sf 9 cells) include the pAc series (Smith et aL (1983) *Mol. Cell Biol.* 3:2156–2165) and the pVL series (Lucklow and Summers (1989) *Virology* 170:31–39).

In another embodiment, the SRT proteins of the invention may be expressed in unicellular plant cells (such as algae) or in plant cells from higher plants (e.g., the spermatophytes, such as crop plants). Examples of plant expression vectors include those detailed in: Becker, D., Kemper, E., Schell, J. and Masterson, R. (1992) "New plant binary vectors with selectable markers located proximal to the left border", *Plant Mol. Biol.* 20: 1195–1197; and Bevan, M. W. (1984) "Binary Agrobacterium vectors for plant transformation", *Nucl. Acid Res.* 12: 8711–8721, and include pLGV23, pGHlac+, pBIN19, pAK2004, and pDH51 (Pouwels et al., eds. (1985) Cloning Vectors. Elsevier: New York IBSN 0 444 904018).

In yet another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et al. (1987) *EMBO J.* 6:187–195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J., Fritsh, E. F., and Maniatis, T. *Molecular Cloning: A Laboratory Manual.* 2nd, ed, Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268–277), lymphoid-specific promoters (Calame and Eaton (1988) *Adv. Immunol.* 43:235–275), in particular promoters of T cell receptors (Winoto and Baltimore (1989) *EMBO J.* 8:729–733) and immunoglobulins (Banerji et al. (1983) *Cell* 33:729–740; Queen and Baltimore (1983) *Cell* 33:741–748), neuron-specific promoters (e.g., the neurofilament promoter, Byrne and Ruddle (1989) *PNAS* 86:5473–5477), pancreas-specific promoters (Edlund et al. (1985) *Science* 230:912–916), and mammary gland-specific promoters (e.g, milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374–379) and the α-fetoprotein promoter (Campes and Tilghman (1989) *Genes Dev.* 3:537–546).

The invention further provides a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to SRT mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see Weintraub, H. et al., Antisense RNA as a molecular tool for genetic analysis, *Reviews—Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, an SRT protein can be expressed in bacterial cells such as *C. glutamicum*, insect cells, yeast or mammalian cells (such as Chinese hamster ovary cells (CHO) or COS cells). Other suitable host cells are known to those of ordinary skill in the art. Microorganisms related to *Corynebacterium glutamicum* which may be conveniently used as host cells for the nucleic acid and protein molecules of the invention are set forth in Table 3.

Vector DNA can be introduced into prokaryotic or eukaryotic cells via conventional transformation or transfection techniques. As used herein, the terms "transformation" and "transfection" are intended to refer to a variety of art-recognized techniques for introducing foreign nucleic acid (e.g., linear DNA or RNA (e.g., a linearized vector or a gene construct alone without a vector) or nucleic acid in the form of a vector (e.g., a plasmid, phage, phasmid, phagemid, transposon or other DNA)) into a host cell, including calcium phosphate or calcium chloride co-precipitation, DEAE-dextran-mediated transfection, lipofection, or electroporation. Suitable methods for transforming or transfecting host cells can be found in Sambrook, et al. (*Molecular Cloning. A Laboratory Manual.* 2nd, ed., Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding an SRT protein or can be introduced on a separate vector. Cells stably transfected with the introduced nucleic acid can be identified by drug selection (e.g., cells that have incorporated the selectable marker gene will survive, while the other cells die).

To create a homologous recombinant microorganism, a vector is prepared which contains at least a portion of an SRT gene into which a deletion, addition or substitution has been introduced to thereby alter, e.g., functionally disrupt, the SRT gene. Preferably, this SRT gene is a Corynebacterium glutamicum SRT gene, but it can be a homologue from a related bacterium or even from a mammalian, yeast, or insect source. In a preferred embodiment, the vector is designed such that, upon homologous recombination, the endogenous SRT gene is functionally disrupted (i.e., no longer encodes a functional protein; also referred to as a "knock out" vector). Alternatively, the vector can be designed such that, upon homologous recombination, the endogenous SRT gene is mutated or otherwise altered but still encodes functional protein (e.g., the upstream regulatory region can be altered to thereby alter the expression of the endogenous SRT protein). In the homologous recombination vector, the altered portion of the SRT gene is flanked at its 5' and 3' ends by additional nucleic acid of the SRT gene to allow for homologous recombination to occur between the exogenous SRT gene carried by the vector and an endogenous SRT gene in a microorganism. The additional flanking SRT nucleic acid is of sufficient length for successful homologous recombination with the endogenous gene. Typically, several kilobases of flanking DNA (both at the 5' and 3' ends) are included in the vector (see e.g., Thomas, K. R., and Capecchi, M. R. (1987) Cell 51: 503 for a description of homologous recombination vectors). The vector is introduced into a microorganism (e.g., by electroporation) and cells in which the introduced SRT gene has homologously recombined with the endogenous SRT gene are selected, using art-known techniques.

In another embodiment, recombinant microorganisms can be produced which contain selected systems which allow for regulated expression of the introduced gene. For example, inclusion of an SRT gene on a vector placing it under control of the lac operon permits expression of the SRT gene only in the presence of IPTG. Such regulatory systems are well known in the art.

In another embodiment, an endogenous SRT gene in a host cell is disrupted (e.g., by homologous recombination or other genetic means known in the art) such that expression of its protein product does not occur. In another embodiment, an endogenous or introduced SRT gene in a host cell has been altered by one or more point mutations, deletions, or inversions, but still encodes a functional SRT protein. In still another embodiment, one or more of the regulatory regions (e.g., a promoter, repressor, or inducer) of an SRT gene in a microorganism has been altered (e.g., by deletion, truncation, inversion, or point mutation) such that the expression of the SRT gene is modulated. One of ordinary skill in the art will appreciate that host cells containing more than one of the described SRT gene and protein modifications may be readily produced using the methods of the invention, and are meant to be included in the present invention.

A host cell of the invention, such as a prokaryotic or eukaryotic host cell in culture, can be used to produce (i.e., express) an SRT protein. Accordingly, the invention further provides methods for producing SRT proteins using the host cells of the invention. In one embodiment, the method comprises culturing the host cell of invention (into which a recombinant expression vector encoding an SRT protein has been introduced, or into which genome has been introduced a gene encoding a wild-type or altered SRT protein) in a suitable medium until SRT protein is produced. In another embodiment, the method further comprises isolating SRT proteins from the medium or the host cell.

C Isolated SRT Proteins

Another aspect of the invention pertains to isolated SRT proteins, and biologically active portions thereof. An "isolated" or "purified" protein or biologically active portion thereof is substantially free of cellular material when produced by recombinant DNA techniques, or chemical precursors or other chemicals when chemically synthesized. The language "substantially free of cellular material" includes preparations of SRT protein in which the protein is separated from cellular components of the cells in which it is naturally or recombinantly produced. In one embodiment, the language "substantially free of cellular material" includes preparations of SRT protein having less than about 30% (by dry weight) of non-SRT protein (also referred to herein as a "contaminating protein"), more preferably less than about 20% of non-SRT protein, still more preferably less than about 10% of non-SRT protein, and most preferably less than about 5% non-SRT protein. When the SRT protein or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations of SRT protein in which the protein is separated from chemical precursors or other chemicals which are involved in the synthesis of the protein. In one embodiment, the language "substantially free of chemical precursors or other chemicals" includes preparations of SRT protein having less than about 30% (by dry weight) of chemical precursors or non-SRT chemicals, more preferably less than about 20% chemical precursors or non-SRT chemicals, still more preferably less than about 10% chemical precursors or non-SRT chemicals, and most preferably less than about 5% chemical precursors or non-SRT chemicals. In preferred embodiments, isolated proteins or biologically active portions thereof lack contaminating proteins from the same organism from which the SRT protein is derived. Typically, such proteins are produced by recombinant expression of, for example, a *C. glutamicum* SRT protein in a microorganism such as *C. glutamicum*.

An isolated SRT protein or a portion thereof of the invention can contribute to the resistance or tolerance of *C. glutamicum* to one or more chemical or environmental stresses or hazards, or has one or more of the activities set forth in Table 1. In preferred embodiments, the protein or portion thereof comprises an amino acid sequence which is sufficiently homologous to an amino acid sequence of Appendix B such that the protein or portion thereof maintains the ability to mediate the resistance or tolerance of *C. glutamicum* to one or more chemical or environmental stresses or hazards. The portion of the protein is preferably a biologically active portion as described herein. In another preferred embodiment, an SRT protein of the invention has an amino acid sequence shown in Appendix B. In yet another preferred embodiment, the SRT protein has an amino acid sequence which is encoded by a nucleotide sequence which hybridizes, e.g., hybridizes under stringent conditions, to a nucleotide sequence of Appendix A. In still another preferred embodiment, the SRT protein has an amino acid sequence which is encoded by a nucleotide sequence that is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89/o, or 90%, or 91%, 92%, 93%, 94%, and even more preferably at least about 95%, 96%, 97%, 98%, 99% or more homologous to one of the nucleic acid sequences of Appendix A, or a portion thereof. Ranges and identity values intermediate to the above-recited values, (e.g., 70–90% identical or 80–95% identical) are also intended to be encompassed by the present invention. For example, ranges of identity values using a combination of any of the above values recited as upper and/or lower limits are intended to be included. The preferred SRT proteins of the present invention also preferably possess at least one of the SRT activities described herein. For example, a preferred SRT protein of the present invention includes an amino acid sequence encoded by a nucleotide sequence which hybridizes, e.g., hybridizes under stringent conditions, to a nucleotide sequence of Appendix A, and which can increase the resistance or tolerance of *C. glutamicum* to one or more environmental or chemical stresses, or which has one or more of the activities set forth in Table 1.

In other embodiments, the SRT protein is substantially homologous to an amino acid sequence of Appendix B and retains the functional activity of the protein of one of the sequences of Appendix B yet differs in amino acid sequence due to natural variation or mutagenesis, as described in detail in subsection I above. Accordingly, in another embodiment, the SRT protein is a protein which comprises an amino acid sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to an entire amino acid sequence of Appendix B and which has at least one of the SRT activities described herein. Ranges and identity values intermediate to the above-recited values, (e.g., 70–90% identical or 80–95% identical) are also intended to be encompassed by the present invention. For example, ranges of identity values using a combination of any of the above values recited as upper and/or lower limits are intended to be included. In another embodiment, the invention pertains to a full length *C. glutamicum* protein which is substantially homologous to an entire amino acid sequence of Appendix B.

Biologically active portions of an SRT protein include peptides comprising amino acid sequences derived from the amino acid sequence of an SRT protein, e.g., an amino acid sequence shown in Appendix B or the amino acid sequence of a protein homologous to an SRT protein, which include fewer amino acids than a full length SRT protein or the full length protein which is homologous to an SRT protein, and exhibit at least one activity of an SRT protein. Typically, biologically active portions (peptides, e.g., peptides which are, for example, 5, 10, 15, 20, 30, 35, 36, 37, 38, 39, 40, 50, 100 or more amino acids in length) comprise a domain or motif with at least one activity of an SRT protein. Moreover, other biologically active portions, in which other regions of the protein are deleted, can be prepared by recombinant techniques and evaluated for one or more of the activities described herein. Preferably, the biologically active portions of an SRT protein include one or more selected domains/motifs or portions thereof having biological activity.

SRT proteins are preferably produced by recombinant DNA techniques. For example, a nucleic acid molecule encoding the protein is cloned into an expression vector (as described above), the expression vector is introduced into a host cell (as described above) and the SRT protein is expressed in the host cell. The SRT protein can then be isolated from the cells by an appropriate purification scheme using standard protein purification techniques. Alternative to recombinant expression, an SRT protein, polypeptide, or peptide can be synthesized chemically using standard peptide synthesis techniques. Moreover, native SRT protein can be isolated from cells (e.g., endothelial cells), for example using an anti-SRT antibody, which can be produced by standard techniques utilizing an SRT protein or fragment thereof of this invention.

The invention also provides SRT chimeric or fusion proteins. As used herein, an SRT "chimeric protein" or "fusion protein" comprises an SRT polypeptide operatively linked to a non-SRT polypeptide. An "SRT polypeptide" refers to a polypeptide having an amino acid sequence corresponding to SRT, whereas a "non-SRT polypeptide" refers to a polypeptide having an amino acid sequence corresponding to a protein which is not substantially homologous to the SRT protein, e.g., a protein which is different from the SRT protein and which is derived from the same or a different organism. Within the fusion protein, the term "operatively linked" is intended to indicate that the SRT polypeptide and the non-SRT polypeptide are fused in-frame to each other. The non-SRT polypeptide can be fused to the N-terminus or C-terminus of the SRT polypeptide. For example, in one embodiment the fusion protein is a GST-SRT fusion protein in which the SRT sequences are fused to the C-terminus of the GST sequences. Such fusion proteins can facilitate the purification of recombinant SRT proteins. In another embodiment, the fusion protein is an SRT protein containing a heterologous signal sequence at its N-terminus. In certain host cells (e.g., mammalian host cells), expression and/or secretion of an SRT protein can be increased through use of a heterologous signal sequence.

Preferably, an SRT chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, eds. Ausubel et al. John Wiley & Sons: 1992). Moreover, many expression vectors are commercially available that already encode a fusion moiety (e.g., a GST polypeptide). An SRT-encoding nucleic acid can be cloned into such an expression vector such that the fusion moiety is linked in-frame to the SRT protein.

Homologues of the SRT protein can be generated by mutagenesis, e.g., discrete point mutation or truncation of the SRT protein. As used herein, the term "homologue" refers to a variant form of the SRT protein which acts as an agonist or antagonist of the activity of the SRT protein. An agonist of the SRT protein can retain substantially the same, or a subset, of the biological activities of the SRT protein. An antagonist of the SRT protein can inhibit one or more of the activities of the naturally occurring form of the SRT protein, by, for example, competitively binding to a downstream or upstream member of the SRT system which includes the SRT protein. Thus, the *C. glutamicum* SRT protein and homologues thereof of the present invention may increase the tolerance or resistance of *C. glutamicum* to one or more chemical or environmental stresses.

In an alternative embodiment, homologues of the SRT protein can be identified by screening combinatorial libraries of mutants, e.g., truncation mutants, of the SRT protein for SRT protein agonist or antagonist activity. In one embodiment, a variegated library of SRT variants is generated by combinatorial mutagenesis at the nucleic acid level and is encoded by a variegated gene library. A variegated library of SRT variants can be produced by, for example, enzymatically ligating a mixture of synthetic oligonucleotides into gene sequences such that a degenerate set of potential SRT sequences is expressible as individual polypeptides, or alternatively, as a set of larger fusion proteins (e.g., for phage display) containing the set of SRT sequences therein. There are a variety of methods which can be used to produce libraries of potential SRT homologues from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential SRT sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477.

In addition, libraries of fragments of the SRT protein coding can be used to generate a variegated population of SRT fragments for screening and subsequent selection of homologues of an SRT protein. In one embodiment, a library of coding sequence fragments can be generated by treating a double stranded PCR fragment of an SRT coding sequence with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the SRT protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of SRT homologues. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique which enhances the frequency of functional mutants in the libraries, can be used in combination with the screening assays to identify SRT homologues (Arkin and Yourvan (1992) *PNAS* 89:7811–7815; Delgrave et al. (1993) *Protein Engineering* 6(3):327–331).

In another embodiment, cell based assays can be exploited to analyze a variegated SRT library, using methods well known in the art.

D. Uses and Methods of the Invention

The nucleic acid molecules, proteins, protein homologues, fusion proteins, primers, vectors, and host cells described herein can be used in one or more of the following methods: identification of *C. glutamicum* and related organisms; mapping of genomes of organisms related to *C. glutamicum*; identification and localization of *C. glutamicum* sequences of interest; evolutionary studies; determination of SRT protein regions required for function; modulation of an SRT protein activity; modulation of the activity of an SRT pathway; and modulation of cellular production of a desired compound, such as a fine chemical.

The SRT nucleic acid molecules of the invention have a variety of uses. First, they may be used to identify an organism as being *Corynebacterium glutamicum* or a close relative thereof. Also, they may be used to identify the presence of *C. glutamicum* or a relative thereof in a mixed population of microorganisms. The invention provides the nucleic acid sequences of a number of *C. glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present.

Although *Corynebacterium glutamicum* itself is nonpathogenic, it is related to pathogenic species, such as *Corynebacterium diphtheriae*. *Corynebacterium diphtheriae* is the causative agent of diphtheria, a rapidly developing, acute, febrile infection which involves both local and systemic pathology. In this disease, a local lesion develops in the upper respiratory tract and involves necrotic injury to epithelial cells; the bacilli secrete toxin which is disseminated through this lesion to distal susceptible tissues of the body. Degenerative changes brought about by the inhibition of protein synthesis in these tissues, which include heart, muscle, peripheral nerves, adrenals, kidneys, liver and spleen, result in the systemic pathology of the disease.

Diphtheria continues to have high incidence in many parts of the world, including Africa, Asia, Eastern Europe and the independent states of the former Soviet Union. An ongoing epidemic of diphtheria in the latter two regions has resulted in at least 5,000 deaths since 1990.

In one embodiment, the invention provides a method of identifying the presence or activity of *Cornyebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject. *C. glutamicum* and *C. diphtheriae* are related bacteria, and many of the nucleic acid and protein molecules in *C. glutamicum* are homologous to *C. diphtheriae* nucleic acid and protein molecules, and can therefore be used to detect *C. diphtheriae* in a subject.

The nucleic acid and protein molecules of the invention may also serve as markers for specific regions of the genome. This has utility not only in the mapping of the genome, but also for functional studies of *C. glutamicum* proteins. For example, to identify the region of the genome to which a particular *C. glutamicum* DNA-binding protein binds, the *C. glutamicum* genome could be digested, and the fragments incubated with the DNA-binding protein. Those which bind the protein may be additionally probed with the nucleic acid molecules of the invention, preferably with readily detectable labels; binding of such a nucleic acid molecule to the genome fragment enables the localization of the fragment to the genome map of *C. glutamicum*, and, when performed multiple times with different enzymes, facilitates a rapid determination of the nucleic acid sequence to which the protein binds. Further, the nucleic acid molecules of the invention may be sufficiently homologous to the sequences of related species such that these nucleic acid molecules may serve as markers for the construction of a genomic map in related bacteria, such as *Brevibacterium lactofermentum*.

The SRT nucleic acid molecules of the invention are also useful for evolutionary and protein structural studies. The resistance processes in which the molecules of the invention participate are utilized by a wide variety of cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

The genes of the invention, e.g., the gene encoding LMRB (SEQ ID NO:1) or other gene of the invention encoding a chemical or environmental resistance or tolerance protein (e.g., resistance against one or more antibiotics), may be used as genetic markers for the genetic transformation of (e.g., the transfer of additional genes into or disruption of preexisting genes of) organisms such as *C. glutamicum* or other bacterial species. Use of these nucleic acid molecules permits efficient selection of organisms which have incorporated a given transgene cassette (e.g., a plasmid, phage, phasmid, phagemid, transposon, or other nucleic acid element), based on a trait which permits the survival of the organism in an otherwise hostile or toxic environment (e.g., in the presence of an antimicrobial compound). By employing one or more of the genes of the invention as genetic markers, the speed and ease with which organisms having desirable transformed traits (e.g., modulated fine chemical production) are engineered and isolated are improved. While it is advantageous to use the genes of the invention for selection of transformed *C. glutamicum* and related bacteria, it is possible, as described herein, to use homologs (e.g., homologs from other organisms), allelic variants or fragments of the gene retaining desired activity. Furthermore, 5' and 3' regulatory elements of the genes of the invention may be modified as described herein (e.g., by nucleotide substitution, insertion, deletion, or replacement with a more desirable genetic element) to modulate the transcription of the gene. For example, an LMRB variant in which the nucleotide sequence in the region from −1 to −200 5' to the start codon has been altered to modulate (preferably increase) the transcription and/or translation of LMRB may be employed, as can constructs in which a gene of the invention (e.g., the LMRB gene (SEQ ID NO:1)) is functionally coupled to one or more regulatory signals (e.g., inducer or repressor binding sequences) which can be used for modulating gene expression. Similarly, more than one copy of a gene (functional or inactivated) of the invention may be employed.

An additional application of the genes of the invention (e.g, the gene encoding LMRB (SEQ ID NO:1) or other drug- or antibiotic-resistance gene) is in the discovery of new antibiotics which are active against Corynebacteria and/or other bacteria. For example, a gene of the invention may be expressed (or overexpressed) in a suitable host to generate an organism with increased resistance to one or more drugs or antibiotics (in the case of LMRB, lincosamides in particular, especially lincomycin). This type of resistant host can subsequently be used to screen for chemicals with bacteriostatic and/or bacteriocidal activity, such as novel antibiotic compounds. It is possible, in particular, to use the genes of the invention (e.g., the LMRB gene) to identify new antibiotics which are active against those microorganisms which are already resistant to standard antibiotic compounds.

The invention provides methods for screening molecules which modulate the activity of an SRT protein, either by interacting with the protein itself or a substrate or binding partner of the SRT protein, or by modulating the transcription or translation of a SRT nucleic acid molecule of the invention. In such methods, a microorganism expressing one or more SRT proteins of the invention is contacted with one or more test compounds, and the effect of each test compound on the activity or level of expression of the SRT protein is assessed.

Manipulation of the SRT nucleic acid molecules of the invention may result in the production of SRT proteins having functional differences from the wild-type SRT proteins. These proteins may be improved in efficiency or activity, may be present in greater numbers in the cell than is usual, or may be decreased in efficiency or activity. The goal of such manipulations is to increase the viability and activity of the cell when the cell is exposed to the environmental and chemical stresses and hazards which frequently accompany large-scale fermentative culture. Thus, by increasing the activity or copy number of a heat-shock-regulated protease, one may increase the ability of the cell to destroy incorrectly folded proteins, which may otherwise interfere with normal cellular functioning (for example, by continuing to bind substrates or cofactors although the protein lacks the activity to act on these molecules appropriately). The same is true for the overexpression or optimization of activity of one or more chaperone molecules induced by heat or cold shock. These proteins aid in the correct folding of nascent polypeptide chains, and thus their increased activity or presence should increase the percentage of correctly folded proteins in the cell, which in turn should increase the overall metabolic efficiency and viability of the cells in culture. The overexpression or optimization of the transporter molecules activated by osmotic shock should result in an increased ability on the part of the cell to maintain intracellular homeostasis, thereby increasing the viability of these cells in culture. Similarly, the overproduction or increase in activity by mutagenesis of proteins involved in the development of cellular resistance to chemical stresses of various kinds (either by transport of the offending chemical out of the cell or by modification of the chemical to a less hazardous substance) should increase the fitness of the organism in the environment containing the hazardous substance (i.e., large-scale fermentative culture), and thereby may permit relatively larger numbers of cells to survive in such a culture. The net effect of all of these mutagenesis strategies is to increase the quantity of fine-chemical-producing compounds in the culture, thereby increasing the yield, production, and/or efficiency of production of one or more desired fine chemicals from the culture.

This aforementioned list of mutagenesis strategies for SRT proteins to result in increased yields of a desired compound is not meant to be limiting; variations on these mutagenesis strategies will be readily apparent to one of ordinary skill in the art. By these mechanisms, the nucleic acid and protein molecules of the invention may be utilized to generate $C.$ $glutamicum$ or related strains of bacteria expressing mutated. SRT nucleic acid and protein molecules such that the yield, production, and/or efficiency of production of a desired compound is improved. This desired compound may be any natural product of $C.$ $glutamicum$, which includes the final products of biosynthesis pathways and intermediates of naturally-occurring metabolic pathways, as well as molecules which do not naturally occur in the metabolism of $C.$ $glutamicum$, but which are produced by a $C.$ $glutamicum$ strain of the invention.

This invention is further illustrated by the following examples which should not be construed as limiting. The contents of all references, patent applications, patents, published patent applications, Tables, Appendices, and the sequence listing cited throughout this application are hereby incorporated by reference.
Exemplification

EXAMPLE 1

Preparation of Total Genomic DNA of
Corynebacterium glutamicum ATCC 13032

A culture of Corynebacterium glutamicum (ATCC 13032) was grown overnight at 30° C. with vigorous shaking in BHI medium (Difco). The cells were harvested by centrifugation, the supernatant was discarded and the cells were resuspended in 5 ml buffer-I (5% of the original volume of the culture all indicated volumes have been calculated for 100 ml of culture volume). Composition of buffer-I: 140.34 g/l sucrose, 2.46 g/l $MgSO_4 \times 7H_2O$, 10 ml/l $KH_2PO_4$ solution (100 g/l, adjusted to pH 6.7 with KOH), 50 ml/l M12 concentrate (10 g/l $(NH_4)_2SO_4$, 1 g/l NaCl, 2 g/l $MgSO_4 \times 7H_2O$, 0.2 g/l $CaCl_2$, 0.5 g/l yeast extract (Difco), 10 m/l trace-elements-mix (200 mg/l $FeSO_4 \times H_2O$, 10 mg/l $ZnSO_4 \times 7H_2O$, 3 mg/l $MnCl_2 \times 4H_2O$, 30 mg/l $H_3BO_3$ 20 mg/l $CoCl_2 \times 6H_2O$, 1 mg/l $NiCl_2 \times 6H_2O$, 3 mg/l $Na_2MoO_4 \times 2H_2O$, 500 mg/l complexing agent (EDTA or critic acid), 100 ml/l vitamins-mix (0.2 mg/l biotin, 0.2 mg/l folic acid, 20 mg/l p-amino benzoic acid, 20 mg/l riboflavin, 40 mg/l ca-panthothenate, 140 mg/l nicotinic acid, 40 mg/l pyridoxole hydrochloride, 200 mg/l myo-inositol). Lysozyme was added to the suspension to a final concentration of 2.5 mg/ml. After an approximately 4 h incubation at 37° C., the cell wall was degraded and the resulting protoplasts are harvested by centrifugation. The pellet was washed once with 5 ml buffer-I and once with 5 ml TE-buffer (10 mM Tris-HCl, 1 mM EDTA, pH 8). The pellet was resuspended in 4 ml TE-buffer and 0.5 ml SDS solution (10%) and 0.5 ml NaCl solution (5 M) are added. After adding of proteinase K to a final concentration of 200 µg/ml, the suspension is incubated for ca.18 h at 37° C. The DNA was purified by extraction with phenol, phenol-chloroform-isoamylalcohol and chloroform-isoamylalcohol using standard procedures. Then, the DNA was precipitated by adding 1/50 volume of 3 M sodium acetate and 2 volumes of ethanol, followed by a 30 min incubation at −20° C. and a 30 min centrifugation at 12,000 rpm in a high speed centrifuge using a SS34 rotor (Sorvall). The DNA was dissolved in 1 ml TE-buffer containing 20 µg/ml RNaseA and dialysed at 4° C. against 1000 ml TE-buffer for at least 3 hours. During this time, the buffer was exchanged 3 times. To aliquots of 0.4 ml of the dialysed DNA solution, 0.4 ml of 2 M LiCl and 0.8 ml of ethanol are added. After a 30 min incubation at −20° C., the DNA was collected by centrifugation (13,000 rpm, Biofuge Fresco, Heraeus, Hanau, Germany). The DNA pellet was dissolved in TE-buffer. DNA prepared by this procedure could be used for all purposes, including southern blotting or construction of genomic libraries.

EXAMPLE 2

Construction of Genomic Libraries in Escherichia
coli of Corynebacterium glutamicum ATCC13032.

Using DNA prepared as described in Example 1, cosmid and plasmid libraries were constructed according to known and well established methods (see e.g. Sambrook, J. et al. (1989) "Molecular Cloning: A Laboratory Manual", Cold Spring Harbor Laboratory Press, or Ausubel, F. M. et al. (1994) "Current Protocols in Molecular Biology", John Wiley & Sons.)

Any plasmid or cosmid could be used. Of particular use were the plasmids pBR322 (Sutcliffe, J. G. (1979) Proc. Natl. Acad. Sci. USA, 75:3737–3741); pACYC177 (Change & Cohen (1978)J. Bacteriol 134:1141–1156), plasmids of the pBS series (pBSSK+, pBSSK− and others; Stratagene, LaJolla, USA), or cosmids as SuperCos1 (Stratagene, LaJolla, USA) or Loris 6 (Gibson, T. J., Rosenthal A. and Waterson, R. H. (1987) Gene 53:283–286. Gene libraries specifically for use in C. glutamicum may be constructed using plasmid pSL109 (Lee, H. -S. and A. J. Sinskey (1994) J. Microbiol. Biotechnol. 4: 256–263).

EXAMPLE 3

DNA Sequencing and Computational Functional
Analysis

Genomic libraries as described in Example 2 were used for DNA sequencing according to standard methods, in particular by the chain termination method using ABI377 sequencing machines (see e.g., Fleischman, R. D. et al. (1995) "Whole-genome Random Sequencing and Assembly of Haemophilus Influenzae Rd., Science, 269:496–512).

Sequencing primers with the following nucleotide sequences were used: 5'-GGAAACAGTATGACCATG-3' (SEQ ID NO: 305, or 5'-GTAAAACGACGGCCAGT-3' (SEQ ID NO: 306.

EXAMPLE 4

In vivo Mutagenesis

In vivo mutagenesis of *Corynebacterium glutamicum* can be performed by passage of plasmid (or other vector) DNA through *E. coli* or other microorganisms (e.g. Bacillus spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D. (1996) DNA repair mechanisms, in: *Escherichia coli* and Salmonella, p. 2277–2294, ASM: Washington.) Such strains are well known to those of ordinary skill in the art. The use of such strains is illustrated, for example, in Greener, A. and Callahan, M. (1994) *Strategies* 7: 32–34.

EXAMPLE 5

DNA Transfer Between *Escherichia coli* and *Corynebacterium glutamicum*

Several Corynebacterium and Brevibacterium species contain endogenous plasmids (as e.g., pHM1519 or pBL1) which replicate autonomously (for review see, e.g., Martin, J. F. et al; (1987) *Biotechnology*, 5:137–146). Shuttle vectors for *Escherichia coli* and *Corynebacterium glutamicum* can be readily constructed by using standard vectors for *E. coli* (Sambrook, J. et al. (1989), "Molecular Cloning: A Laboratory Manual", Cold Spring Harbor Laboratory Press or Ausubel, F. M. et al. (1994) "Current Protocols in Molecular Biology", John Wiley & Sons) to which a origin or replication for and a suitable marker from *Corynebacterium glutamicum* is added. Such origins of replication are preferably taken from endogenous plasmids isolated from Corynebacterium and Brevibacterium species. Of particular use as transformation markers for these species are genes for kanamycin resistance (such as those derived from the Tn5 or Tn903 transposons) or chloramphenicol (Winnacker, E. L. (1987) "From Genes to Clones—Introduction to Gene Technology, VCH, Weinheim). There are numerous examples in the literature of the construction of a wide variety of shuttle vectors which replicate in both *E. coli* and *C. glutamicum*, and which can be used for several purposes, including gene over-expression (for reference, see e.g., Yoshihama, M. et al. (1985) *J. Bacteriol.* 162:591–597, Martin J. F. et al. (1987) *Biotechnology*, 5:137–146 and Eikmanns, B. J. et al. (1991) *Gene*, 102:93–98).

Using standard methods, it is possible to clone a gene of interest into one of the shuttle vectors described above and to introduce such a hybrid vector into strains of *Corynebacterium glutamicum*. Transformation of *C. glutamicum* can be achieved by protoplast transformation (Kastsumata, R. et al. (1984) *J. Bacteriol.* 159306–311), electroporation (Liebl, E. et al. (1989) *FEMS Microbiol. Letters,* 53:399–303) and in cases where special vectors are used, also by conjugation (as described e.g. in Schäfer, A et al. (1990) *J. Bacteriol.* 172:1663–1666). It is also possible to transfer the shuttle vectors for *C. glutamicum* to *E. coli* by preparing plasmid DNA from *C. glutamicum* (using standard methods well-known in the art) and transforming it into *E. coli*. This transformation step can be performed using standard methods, but it is advantageous to use an Mcr-deficient *E. coli* strain, such as NM522 (Gough & Murray (1983) *J. Mol. Biol.* 166:1–19).

Genes may be overexpressed in *C. glutamicum* strains using plasmids which comprise pCG1 (U.S. Pat. No. 4,617, 267) or fragments thereof, and optionally the gene for kanamycin resistance from TN903 (Grindley, N. D. and Joyce, C. M. (1980) *Proc. Natl. Acad. Sci. USA* 77(12): 7176–7180). In addition, genes may be overexpressed in *C. glutamicum* strains using plasmid pSL109 (Lee, H. -S. and A. J. Sinskey (1994) *J. Microbiol. Biotechnol.* 4: 256–263).

Aside from the use of replicative plasmids, gene overexpression can also be achieved by integration into the genome. Genomic integration in *C. glutamicum* or other Corynebacterium or Brevibacterium species may be accomplished by well-known methods, such as homologous recombination with genomic region(s), restriction endonuclease mediated integration (REMI) (see, e.g., DE Patent 19823834), or through the use of transposons. It is also possible to modulate the activity of a gene of interest by modifying the regulatory regions (e.g., a promoter, a repressor, and/or an enhancer) by sequence modification, insertion, or deletion using site-directed methods (such as homologous recombination) or methods based on random events (such as transposon mutagenesis or REMI). Nucleic acid sequences which function as transcriptional terminators may also be inserted 3' to the coding region of one or more genes of the invention; such terminators are well-known in the art and are described, for example, in Winnacker, E. L. (1987) From Genes to Clones—Introduction to Gene Technology. VCH: Weinheim.

EXAMPLE 6

Assessment of the Expression of the Mutant Protein

Observations of the activity of a mutated protein in a transformed host cell rely on the fact that the mutant protein is expressed in a similar fashion and in a similar quantity to that of the wild-type protein. A usefull method to ascertain the level of transcription of the mutant gene (an indicator of the amount of mRNA available for translation to the gene product) is to perform a Northern blot (for reference see, for example, Ausubel et al. (1988) Current Protocols in Molecular Biology, Wiley: New York), in which a primer designed to bind to the gene of interest is labeled with a detectable tag (usually radioactive or chemiluminescent), such that when the total RNA of a culture of the organism is extracted, run on gel, transferred to a stable matrix and incubated with this probe, the binding and quantity of binding of the probe indicates the presence and also the quantity of mRNA for this gene. This information is evidence of the degree of transcription of the mutant gene. Total cellular RNA can be prepared from *Corynebacterium glutamicum* by several methods, all well-known in the art, such as that described in Bormann, E. R. et al. (1992) *Mol. Microbiol.* 6: 317–326.

To assess the presence or relative quantity of protein translated from this mRNA, standard techniques, such as a Western blot, may be employed (see, for example, Ausubel et al. (1988) Current Protocols in Molecular Biology, Wiley: New York). In this process, total cellular proteins are extracted, separated by gel electrophoresis, transferred to a matrix such as nitrocellulose, and incubated with a probe, such as an antibody, which specifically binds to the desired protein. This probe is generally tagged with a chemiluminescent or calorimetric label which may be readily detected.

The presence and quantity of label observed indicates the presence and quantity of the desired mutant protein present in the cell.

EXAMPLE 7

Growth of Genetically Modified *Corynebacterium glutamicum*—Media and Culture Conditions Genetically modified Corynebacteria are cultured in synthetic or natural growth media. A number of different growth media for Corynebacteria are both well-known and readily available (Lieb et al. (1989) *Appl. Microbiol. Biotechnol.*, 32:205–210; von der Osten et al. (1998) *Biotechnology Letters*, 11:11–16; Patent DE 4,120,867; Lieb; (1992) "The Genus Corynebacterium, in: The Procaryotes, Volume II, Balows, A. et al., eds. Springer-Verlag). These media consist of one or more carbon sources, nitrogen sources, inorganic salts, vitamins and trace elements. Preferred carbon sources are sugars, such as mono-, di-, or polysaccharides. For example, glucose, fructose, mannose, galactose, ribose, sorbose, ribulose, lactose, maltose, sucrose, raffinose, starch or cellulose serve as very good carbon sources. It is also possible to supply sugar to the media via complex compounds such as molasses or other by-products from sugar refinement. It can also be advantageous to supply mixtures of different carbon sources. Other possible carbon sources are alcohols and organic acids, such as methanol, ethanol, acetic acid or lactic acid. Nitrogen sources are usually organic or inorganic nitrogen compounds, or materials which contain these compounds. Exemplary nitrogen sources include ammnonia gas or ammonia salts, such as $NH_4Cl$ or $(NH_4)_2SO_4$, $NH_4OH$, nitrates, urea, amino acids or complex nitrogen sources like corn steep liquor, soy bean flour, soy bean protein, yeast extract, meat extract and others.

Inorganic salt compounds which may be included in the media include the chloride-, phosphorous- or sulfate-salts of calcium, magnesium, sodium, cobalt, molybdenum, potassium, manganese, zinc, copper and iron. Chelating compounds can be added to the medium to keep the metal ions in solution. Particularly useful chelating compounds include dihydroxyphenols, like catechol or protocatechuate, or organic acids, such as citric acid. It is typical for the media to also contain other growth factors, such as vitamins or growth promoters, examples of which include biotin, riboflavin, thiamin, folic acid, nicotinic acid, pantothenate and pyridoxin. Growth factors and salts frequently originate from complex media components such as yeast extract, molasses, corn steep liquor and others. The exact composition of the media compounds depends strongly on the immediate experiment and is individually decided for each specific case. Information about media optimization is available in the textbook "Applied Microbiol. Physiology, A Practical Approach (eds. P. M. Rhodes, P. F. Stanbury, IRL Press (1997) pp. 53–73, ISBN 0 19 963577 3). It is also possible to select growth media from commercial suppliers, like standard 1 (Merck) or BHI (grain heart infusion, DIFCO) or others.

All medium components are sterilized, either by heat (20 minutes at 1.5 bar and 121° C.) or by sterile filtration. The components can either be sterilized together or, if necessary, separately. All media components can be present at the beginning of growth, or they can optionally be added continuously or batchwise.

Culture conditions are defined separately for each experiment. The temperature should be in a range between 15° C. and 45° C. The temperature can be kept constant or can be altered during the experiment. The pH of the medium should be in the range of 5 to 8.5, preferably around 7.0, and can be maintained by the addition of buffers to the media. An exemplary buffer for this purpose is a potassium phosphate buffer. Synthetic buffers such as MOPS, HEPES, ACES and others can alternatively or simultaneously be used. It is also possible to maintain a constant culture pH through the addition of NaOH or $NH_4OH$ during growth. If complex medium components such as yeast extract are utilized, the necessity for additional buffers may be reduced, due to the fact that many complex compounds have high buffer capacities. If a fermentor is utilized for culturing the microorganisms, the pH can also be controlled using gaseous ammonia.

The incubation time is usually in a range from several hours to several days. This time is selected in order to permit the maximal amount of product to accumulate in the broth. The disclosed growth experiments can be carried out in a variety of vessels, such as microtiter plates, glass tubes, glass flasks or glass or metal fermentors of different sizes. For screening a large number of clones, the microorganisms should be cultured in microtiter plates, glass tubes or shake flasks, either with or without baffles. Preferably 100 ml shake flasks are used, filled with 10% (by volume) of the required growth medium. The flasks should be shaken on a rotary shaker (amplitude 25 mm) using a speed-range of 100–300 rpm. Evaporation losses can be diminished by the maintenance of a humid atmosphere; alternatively, a mathematical correction for evaporation losses should be performed.

If genetically modified clones are tested, an unmodified control clone or a control clone containing the basic plasmid without any insert should also be tested. The medium is inoculated to an $OD_{600}$ of 0.5–1.5 using cells grown on agar plates, such as CM plates (10 g/l glucose, 2,5 g/l NaCl, 2 g/l urea, 10 g/l polypeptone, 5 g/l yeast extract, 5 g/l meat extract, 22 g/l NaCl, 2 g/l urea, 10 g/l polypeptone, 5 g/l yeast extract, 5 g/l meat extract, 22 g/l agar, pH 6.8 with 2M NaOH) that had been incubated at 30° C. Inoculation of the media is accomplished by either introduction of a saline suspension of *C. glutamicum* cells from CM plates or addition of a liquid preculture of this *bacterium*.

EXAMPLE 8

In vitro Analysis of the Function of Mutant Proteins

The determination of activities and kinetic parameters of enzymes is well established in the art. Experiments to determine the activity of any given altered enzyme must be tailored to the specific activity of the wild-type enzyme, which is well within the ability of one of ordinary skill in the art. Overviews about enzymes in general, as well as specific details concerning structure, kinetics, principles, methods, applications and examples for the determination of many enzyme activities may be found, for example, in the following references: Dixon, M., and Webb, E. C., (1979) Enzymes. Longmans: London; Fersht, (1985) Enzyme Structure and Mechanism. Freeman: New York; Walsh, (1979) Enzymatic Reaction Mechanisms. Freeman: San Francisco; Price, N. C., Stevens, L. (1982) Fundamentals of Enzymology. Oxford Univ. Press: Oxford; Boyer, P. D., ed. (1983) The Enzymes, $3^{rd}$ ed. Academic Press: New York; Bisswanger, H., (1994) Enzymkinetik, $2^{nd}$ ed. VCH: Weinheim (ISBN 3527300325); Bergmeyer, H. U., Bergmeyer, J., Graβ1, M., eds. (1983–1986) Methods of Enzymatic Analysis, 3rd ed., vol. I–XII, Verlag Chemie: Weinheim; and Ullmann's Encyclopedia of Industrial Chemistry (1987) vol. A9, "Enzymes". VCH: Weinheim, p. 52–363.

The activity of proteins which bind to DNA can be measured by several well-established methods, such as DNA band-shift assays (also called gel retardation assays). The effect of such proteins on the expression of other molecules can be measured using reporter gene assays (such as that described in Kolmar, H. et al. (1995) *EMBO J.* 14: 3895–3904 and references cited therein). Reporter gene test systems are well known and established for applications in both pro- and eukaryotic cells, using enzymes such as beta-galactosidase, green fluorescent protein, and several others.

The determination of activity of membrane-transport proteins can be performed according to techniques such as those described in Gennis, R. B. (1989) "Pores, Channels and Transporters", in Biomembranes, Molecular Structure and Function, Springer: Heidelberg, p. 85–137; 199–234; and 270–322.

EXAMPLE 9

Analysis of Impact of Mutant Protein on the Production of the Desired Product

The effect of the genetic modification in *C. glutamicum* on production of a desired compound (such as an amino acid) can be assessed by growing the modified microorganism under suitable conditions (such as those described above) and analyzing the medium and/or the cellular component for increased production of the desired product (i e., an amino acid). Such analysis techniques are well known to one of ordinary skill in the art, and include spectroscopy, thin layer chromatography, staining methods of various kinds, enzymatic and microbiological methods, and analytical chromatography such as high performance liquid chromatography (see, for example, Ullman, Encyclopedia of Industrial Chemistry, vol. A2, p. 89–90 and p. 443–613, VCH: Weinheim (1985); Fallon, A. et al., (1987) "Applications of HPLC in Biochemistry" in: Laboratory Techniques in Biochemistry and Molecular Biology, vol. 17; Rehm et al. (1993) Biotechnology, vol. 3, Chapter III: "Product recovery and purification", page 469–714, VCH: Weinheim; Belter, P. A. et al. (1988) Bioseparations: downstream processing for biotechnology, John Wiley and Sons; Kennedy, J. F. and Cabral, J. M. S. (1992) Recovery processes for biological materials, John Wiley and Sons; Shaeiwitz, J. A. and Henry, J. D. (1988) Biochemical separations, in: Ulmann's Encyclopedia of Industrial Chemistry, vol. B3, Chapter 11, page 1–27, VCH: Weinheim; and Dechow, F. J. (1989) Separation and purification techniques in biotechnology, Noyes Publications.)

In addition to the measurement of the final product of fermentation, it is also possible to analyze other components of the metabolic pathways utilized for the production of the desired compound, such as intermediates and side-products, to determine the overall yield, production, and/or efficiency of production of the compound. Analysis methods include measurements of nutrient levels in the medium (e.g., sugars, hydrocarbons, nitrogen sources, phosphate, and other ions), measurements of biomass composition and growth, analysis of the production of common metabolites of biosynthetic pathways, and measurement of gasses produced during fermentation. Standard methods for these measurements are outlined in Applied Microbial Physiology, A Practical Approach, P. M. Rhodes and P. F. Stanbury, eds., IRL Press, p. 103–129; 131–163; and 165–192 (ISBN: 0199635773) and references cited therein.

EXAMPLE 10

Purification of the Desired Product from *C. glutamicum* Culture

Recovery of the desired product from the *C. glutamicum* cells or supernatant of the above-described culture can be performed by various methods well known in the art. If the desired product is not secreted from the cells, the cells can be harvested from the culture by low-speed centrifugation, the cells can be lysed by standard techniques, such as mechanical force or sonication. The cellular debris is removed by centrifugation, and the supernatant fraction containing the soluble proteins is retained for further purification of the desired compound. If the product is secreted from the *C. glutamicum* cells, then the cells are removed from the culture by low-speed centrifugation, and the supernate fraction is retained for further purification.

The supernatant fraction from either purification method is subjected to chromatography with a suitable resin, in which the desired molecule is either retained on a chromatography resin while many of the impurities in the sample are not, or where the impurities are retained by the resin while the sample is not. Such chromatography steps may be repeated as necessary, using the same or different chromatography resins. One of ordinary skill in the art would be well-versed in the selection of appropriate chromatography resins and in their most efficacious application for a particular molecule to be purified. The purified product may be concentrated by filtration or ultrafiltration, and stored at a temperature at which the stability of the product is maximized.

There are a wide array of purification methods known to the art and the preceding method of purification is not meant to be limiting. Such purification techniques are described, for example, in Bailey, J. E. & Ollis, D. F. Biochemical Engineering Fundamentals, McGraw-Hill: New York (1986).

The identity and purity of the isolated compounds may be assessed by techniques standard in the art. These include high-performance liquid chromatography (HPLC), spectroscopic methods, staining methods, thin layer chromatography, NIRS, enzymatic assay, or microbiologically. Such analysis methods are reviewed in: Patek et al. (1994) *Appl. Environ. Microbiol.* 60: 133–140; Malakhova et al. (1996) *Biotekhnologiya* 11: 27–32; and Schmidt et al. (1998) *Bioprocess Engineer.* 19: 67–70. Ulmann's Encyclopedia of Industrial Chemistry, (1996) vol. A27, VCH: Weinheim, p. 89–90, p. 521–540, p. 540–547, p. 559–566, 575–581 and p. 581–587; Michal, G. (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

EXAMPLE 11

Cloning of a *Corynebacterium glutamicum* Gene Involved in Lincomycin Resistance Using a Reporter Gene Approach A. Identification of the Gene Encoding the LMRB Protein Plasmid pSL 130 was constructed by ligation of the aceB promoter region (paceB) of *C. glutamicum* (Kim, H. J. et al. (1997) *J. Microbiol. Biotechnol.* 7: 287–292) into the polylinker of the lac operon fusion vector pRS415, which lacks a promoter (Simon, R. W. et al. (1987) *Gene* 53: 85–96). Plasmid pSL145 was constructed by ligating the resulting paceB-lac region into the *E. coli* cloning vector pACYC184. *E. coli* DH5αF' was transformed with pSL145 and the resulting strain was used as a host for screening of a genomic *C. glutamicum* library (in pSL109).

Transformants were screened by growth on agar medium containing 5-bromo-4-chloro-3-indolyl-beta-D-glalactopyranoside (X-Gal). A white colony, containing DNA influencing lacZ expression, was selected for further analysis. This clone was found to contain a 4 kB fragment from the gene library. Subclones were constructed in pSL109 and a subclone which retained the white phenotype on X-Gal plates was identified. This subclone was found to contain a 2.6 kB BamH1-XhoI fragment (plasmid pSL149-5). The fragment was sequenced and identified as a membrane protein-encoding gene (LMRB gene).

The 1442 nucleotides of the coding sequence of the LMRB gene encode a polypeptide of 481 amino acid residues with a high percentage of hydrophobic amino acids. A Genbank search determined that the LMRB protein is 40% identical to the protein product of the lmrB gene from *Bacillus subtilis* (Genbank Accession AL009126, TREMBL Accession P94422), as determined using a CLUSTAL W analysis (using standard parameters).

The LMRN protein contains a sequence pattern: 158-A-P-A-L-G-P-T-L-S-G-167 (SEQ ID NO:301), which resembles the known multi-drug-resistance-protein consensus motif G-X-X-X-G-P-X-X-G-G (SEQ ID NO:302) (Paulsen, I. T., and Skurray, R. A. (1993) *Gene* 124: 1–11). Therefore, the LMRB protein was classified as a drug resistance protein.

B. In vivo Analysis of lmrB Function

The lmrB gene was overexpressed in *C. glutamicum* ASO19E12 (Kim, H. J. et al. (1997) *J. Microbiol. Biotechnol.* 7: 287–292) using the plasmid pSL149-5, described above.

Disruption of the LMRB gene was accomplished by use of the vector pSL 18-lmrB. This vector was constructed as follows: an internal fragment of the LMRB gene was amplified by PCR under standard conditions using primers 5'-CTCCAGGATTGCTCCGAAGG-3' (SEQ ID NO:303) and 5'-CACAGTGGTTGACCACTGGC-3' (SEQ ID NO:304). The resulting PCR product was treated with T7 DNA polymerase and 17 polynucleotide kinase, and cloned into the SmaI site of plasmid pSL18 (Kim, Y. H. and H. -S. Lee (1996) *J. Microbiol. Biotechnol.* 6: 315–320). The disruption of the LMRB gene in *C. glutamicum* ASO19E12 was performed by conjugation, as previously described (Schwarzer and Puhler (1991) *Bio/Technology* 9:84–87).

*C. glutamicum* cells transformed with pSL149-5 displayed similar resistances as untransformed cells against erythromycin, penicillin G, tetracycline, chloramphenicol, spectinomycin, nalidixic acid, gentamycin, streptomycin, ethidium bromide, carbonyl cyanide m-chlorophenylhydrazone (CCCP), and sodium dodecyl sulfate. Significant differences were observed, however, in the resistance of transformed and untransformed cells to lincomycin.

LMRB-overexpressing *C. glutamicum* cells were found to be able to grow in the presence of 20 μg/ml lincomycin. In contrast, cells which do not overexpress LMRB (or cells carrying a LMRB disruption) were not able to grow on agar media containing 5 μg/ml lincomycin. This effect was clearly visible in liquid culture. LMRB overexpression led to a 9-fold increased resistance (compared to wild-type) against lincomycin and LMRB disruption resulted in a decreased resistance (28% of wild-type) to this antibiotic.

EXAMPLE 12

Analysis of the Gene Sequences of the Invention

The comparison of sequences and determination of percent homology between two sequences are art-known techniques, and can be accomplished using a mathematical algorithm, such as the algorithm of Karlin and Altschul (1990) *Proc. Natl. Acad. Sci. USA* 87:2264–68, modified as in Karlin and Altschul (1993) *Proc. Natl. Acad. Sci. USA* 90:5873–77. Such an algorithm is incorporated into the NBLAST and XBLAST programs (version 2.0) of Altschul, et al. (1990) *J. Mol. Biol.* 215:403–10. BLAST nucleotide searches can be performed with the NBLAST program, score=100, wordlength=12 to obtain nucleotide sequences homologous to SRT nucleic acid molecules of the invention. BLAST protein searches can be performed with the XBLAST program, score=50, wordlength=3 to obtain amino acid sequences homologous to SRT protein molecules of the invention. To obtain gapped alignments for comparison purposes, Gapped BLAST can be utilized as described in Altschul et al., (1997) *Nucleic Acids Res.* 25(17) :3389–3402. When utilizing BLAST and Gapped BLAST programs, one of ordinary skill in the art will know how to optimize the parameters of the program (e.g., XBLAST and NBLAST) for the specific sequence being analyzed.

Another example of a mathematical algorithm utilized for the comparison of sequences is the algorithm of Meyers and Miller ((1988) *Comput. Appl. Biosci.* 4: 11–17). Such an algorithm is incorporated into the ALIGN program (version 2.0) which is part of the GCG sequence alignment software package. When utilizing the ALIGN program for comparing amino acid sequences, a PAM 120 weight residue table, a gap length penalty of 12, and a gap penalty of 4 can be used. Additional algorithms for sequence analysis are known in the art, and include ADVANCE and ADAM. described in Torelli and Robotti (1994) *Comput. Appl. Biosci.* 10:3–5; and FASTA, described in Pearson and Lipman (1988) *P.N.A.S.* 85:2444–8.

The percent homology between two amino acid sequences can also be accomplished using the GAP program in the GCG software package (available at http://www.gcg.com), using either a Blosum 62 matrix or a PAM250 matrix, and a gap weight of 12, 10, 8, 6, or 4 and a length weight of 2, 3, or 4. The percent homology between two nucleic acid sequences can be accomplished using the GAP program in the GCG software package, using standard parameters, such as a gap weight of 50 and a length weight of 3.

A comparative analysis of the gene sequences of the invention with those present in Genbank has been performed using techniques known in the art (see, e.g., Bexevanis and Ouellette, eds. (1998) Bioinformatics: A Practical Guide to the Analysis of Genes and Proteins. John Wiley and Sons: New York). The gene sequences of the invention were compared to genes present in Genbank in a three-step process. In a first step, a BLASTN analysis (e.g., a local alignment analysis) was performed for each of the sequences of the invention against the nucleotide sequences present in Genbank, and the top 500 hits were retained for further analysis. A subsequent FASTA search (e.g., a combined local and global alignment analysis, in which limited regions of the sequences are aligned) was performed on these 500 hits. Each gene sequence of the invention was subsequently globally aligned to each of the top three FASTA hits, using the GAP program in the GCG software package (using standard parameters). In order to obtain correct results, the length of the sequences extracted from Genbank were adjusted to the length of the query sequences by methods well-known in the art. The results of this analysis are set forth in Table 4. The resulting data is identical to that which would have been obtained had a GAP (global) analysis alone been performed on each of the genes of the invention in comparison with each of the references in Genbank, but required significantly reduced computational time as compared to such a database-wide GAP (global) analysis. Sequences of the invention for which no alignments above the cutoff values were obtained are indicated on Table 4 by the absence of alignment information. It will further be understood by one of ordinary skill in the art that the GAP alignment homology percentages set forth in Table 4 under the heading "% homology (GAP)" are listed in the European numerical format, wherein a ',' represents a decimal point. For example, a value of "40,345" in this column represents "40.345%".

EXAMPLE 13

Construction and Operation of DNA Microarrays

The sequences of the invention may additionally be used in the construction and application of DNA microarrays (the design, methodology, and uses of DNA arrays are well known in the art, and are described, for example, in Schena, M. et al. (1995) Science 270: 467–470; Wodicka, L. et al. (1997) Nature Biotechnology 15: 1359–1367; DeSaizieu, A. et al. (1998) Nature Biotechnology 16: 4548; and DeRisi, J. L. et al. (1997) Science 278: 680–686).

DNA microarrays are solid or flexible supports consisting of nitrocellulose, nylon, glass, silicone, or other materials. Nucleic acid molecules may be attached to the surface in an ordered manner. After appropriate labeling, other nucleic acids or nucleic acid mixtures can be hybridized to the immobilized nucleic acid molecules, and the label may be used to monitor and measure the individual signal intensities of the hybridized molecules at defined regions. This methodology allows the simultaneous quantification of the relative or absolute amount of all or selected nucleic acids in the applied nucleic acid sample or mixture. DNA microarrays, therefore, permit an analysis of the expression of multiple (as many as 6800 or more) nucleic acids in parallel (see, e.g., Schena, M. (1996) BioEssasys 18(5): 427–431).

The sequences of the invention may be used to design oligonucleotide primers which are able to amplify defined regions of one or more C. glutamicum genes by a nucleic acid amplification reaction such as the polymerase chain reaction. The choice and design of the 5' or 3' oligonucleotide primers or of appropriate linkers allows the covalent attachment of the resulting PCR products to the surface of a support medium described above (and also described, for example, Schena, M. et al. (1995) Science 270: 467–470).

Nucleic acid microarrays may also be constructed by in situ oligonucleotide synthesis as described by Wodicka, L. et al. (1997) Nature Biotechnology 15: 1359–1367. By photolithographic methods, precisely defined regions of the matrix are exposed to light. Protective groups which are photolabile are thereby activated and undergo nucleotide addition, whereas regions that are masked from light do not undergo any modification. Subsequent cycles of protection and light activation permit the synthesis of different oligonucleotides at defined positions. Small, defined regions of the genes of the invention may be synthesized on microarrays by solid phase oligonucleotide synthesis.

The nucleic acid molecules of the invention present in a sample or mixture of nucleotides may be hybridized to the microarrays. These nucleic acid molecules can be labeled according to standard methods. In brief, nucleic acid molecules (e.g., mRNA molecules or DNA molecules) are labeled by the incorporation of isotopically or fluorescently labeled nucleotides, e.g., during reverse transcription or DNA synthesis. Hybridization of labeled nucleic acids to microarrays is described (e.g., in Schena, M. et al. (1995) supra; Wodicka, L. et al. (1997), supra; and DeSaizieu A. et al. (1998), supra). The detection and quantification of the hybridized molecule are tailored to the specific incorporated label. Radioactive labels can be detected, for example, as described in Schena, M. et al. (1995) supra) and fluorescent labels may be detected, for example, by the method of Shalon et al. (1996) Genome Research 6: 639–645).

The application of the sequences of the invention to DNA microarray technology, as described above, permits comparative analyses of different strains of C. glutamicum or other Corynebacteria For example, studies of inter-strain variations based on individual transcript profiles and the identification of genes that are important for specific and/or desired strain properties such as pathogenicity, productivity and stress tolerance are facilitated by nucleic acid array methodologies. Also, comparisons of the profile of expression of genes of the invention during the course of a fermentation reaction are possible using nucleic acid array technology.

EXAMPLE 14

Analysis of the Dynamics of Cellular Protein Populations (Proteomics)

The genes, compositions, and methods of the invention may be applied to study the interactions and dynamics of populations of proteins, termed 'proteomics'. Protein populations of interest include, but are not limited to, the total protein population of C. glutamicum (e.g., in comparison with the protein populations of other organisms), those proteins which are active under specific environmental or metabolic conditions (e.g., during fermentation, at high or low temperature, or at high or low pH), or those proteins which are active during specific phases of growth and development.

Protein populations can be analyzed by various well-known techniques, such as gel electrophoresis. Cellular proteins may be obtained, for example, by lysis or extraction, and may be separated from one another using a variety of electrophoretic techniques. Sodium dodecyl sulfate polyacrylamide gel electrophoresis (SDS-PAGE) separates proteins largely on the basis of their molecular weight. Isoelectric focusing polyacrylamide gel electrophoresis (IEF-PAGE) separates proteins by their isoelectric point (which reflects not only the amino acid sequence but also posttranslational modifications of the protein). Another, more preferred method of protein analysis is the consecutive combination of both IEF-PAGE and SDS-PAGE, known as 2-D-gel electrophoresis (described, for example, in Hermann et al. (1998) Electrophoresis 19: 3217–3221; Fountoulakis et al. (1998) Electrophoresis 19: 1193–1202; Langen et al (1997) Electrophoresis 18: 1184–1192; Antelmann et al. (1997) Electrophoresis 18: 1451–1463). Other separation techniques may also be utilized for protein separation, such as capillary gel electrophoresis; such techniques are well known in the art.

Proteins separated by these methodologies can be visualized by standard techniques, such as by staining or labeling. Suitable stains are known in the art, and include Coomassie Brilliant Blue, silver stain, or fluorescent dyes such as Sypro Ruby (Molecular Probes). The inclusion of radioactively labeled amino acids or other protein precursors (e.g., $^{35}$S-methionine, $^{35}$S-cysteine, $^{14}$C-labelled amino acids, $^{15}$N-amino acids, $^{15}$NO$_3$ or $^{15}$NH$_4^+$ or $^{13}$C-labelled amino acids) in the medium of *C. glutamicum* permits the labeling of proteins from these cells prior to their separation. Similarly, fluorescent labels may be employed. These labeled proteins can be extracted, isolated and separated according to the previously described techniques.

Proteins visualized by these techniques can be further analyzed by measuring the amount of dye or label used. The amount of a given protein can be determined quantitatively using, for example, optical methods and can be compared to the amount of other proteins in the same gel or in other gels. Comparisons of proteins on gels can be made, for example, by optical comparison, by spectroscopy, by image scanning and analysis of gels, or through the use of photographic films and screens. Such techniques are well-known in the art.

To determine the identity of any given protein, direct sequencing or other standard techniques may be employed. For example, N- and/or C-terminal amino acid sequencing (such as Edman degradation) may be used, as may mass spectrometry (in particular MALDI or ESI techniques (see, e.g., Langen et al. (1997) *Electrophoresis* 18: 1184–1192)). The protein sequences provided herein can be used for the identification of *C. glutamicum* proteins by these techniques.

The information obtained by these methods can be used to compare patterns of protein presence, activity, or modification between different samples from various biological conditions (e.g., different organisms, time points of fermentation, media conditions, or different biotopes, among others). Data obtained from such experiments alone, or in combination with other techniques, can be used for various applications, such as to compare the behavior of various organisms in a given (e.g., metabolic) situation, to increase the productivity of strains which produce fine chemicals or to increase the efficiency of the production of fine chemicals.

Equivalents

Those of ordinary skill in the art will recognize, or will be able to ascertain using no more than routine experimentation, many equivalents to the specific embodiments of the invention described herein. Such equivalents are intended to be encompassed by the following claims.

TABLE 1

| Nucleic Acid SEQ ID NO | Amino Acid SEQ ID NO | Identification Code | Contig. | NT Start | NT Stop | Function |
|---|---|---|---|---|---|---|
| Genes Included in the Application ||||||||
| 1 | 2 | RXA01524 | GR00424 | 29041 | 30483 | Lincomycine RESISTANCE PROTEIN |
| 3 | 4 | RXA00497 | GR00124 | 52 | 348 | 10 KD CHAPERONIN |
| 5 | 6 | RXN00493 | VV0086 | 14389 | 16002 | 60 KD CHAPERONIN |
| 7 | 8 | F RXA00498 | GR00124 | 363 | 1601 | 60 KD CHAPERONIN |
| 9 | 10 | RXA01217 | GR00353 | 802 | 203 | GENERAL STRESS PROTEIN CTC |
| 11 | 12 | RXA00605 | GR00159 | 7412 | 5865 | CATALASE (EC 1.11.1.6) |
| 13 | 14 | RXA00404 | GR00089 | 2909 | 594 | CARBON STARVATION PROTEIN A |
| 15 | 16 | RXN03119 | VV0098 | 86877 | 87008 | SUPEROXIDE DISMUTASE [MN] (EC 1.15.1.1) |
| 17 | 18 | RXN03120 | VV0098 | 87351 | 87476 | SUPEROXIDE DISMUTASE [MN] (EC 1.15.1.1) |
| 19 | 20 | RXN00575 | VV0323 | 14716 | 15252 | PHOSPHINOTHRICIN-RESISTANCE PROTEIN |
| 21 | 22 | F RXA00575 | GR00156 | 2130 | 1648 | PHOSPHINOTHRICIN-RESISTANCE PROTEIN |
| Chaperones ||||||||
| 23 | 24 | RXN01345 | VV0123 | 4883 | 3432 | Moleculares chaperon (HSP70/DnaK family) |
| 25 | 26 | F RXA01345 | GR00391 | 1172 | 6 | Molecular chaperones (HSP70/DnaK family) |
| 27 | 28 | RXA02541 | GR00726 | 13657 | 12473 | DNAJ PROTEIN |
| 29 | 30 | RXA02542 | GR00726 | 14518 | 13865 | GRPE PROTEIN |
| 31 | 32 | RXN02543 | VV0057 | 22031 | 20178 | DNAK PROTEIN |
| 33 | 34 | F RXA02543 | GR00726 | 16375 | 14522 | DNAK PROTEIN |
| 35 | 36 | RXN02280 | VV0152 | 1849 | 26 | TRAP1 |
| 37 | 38 | F RXA02282 | GR00659 | 1145 | 1480 | Molecular chaperone, HSP90 family |
| 39 | 40 | RXA00886 | GR00242 | 12396 | 13541 | DNAJ PROTEIN |
| 41 | 42 | RXS00568 | VV0251 | 2928 | 1582 | TRIGGER FACTOR |
| 43 | 44 | RXN03038 | VV0017 | 42941 | 43666 | PS1 PROTEIN VORLÄUFER |
| 45 | 46 | RXN03039 | VV0018 | 2 | 631 | PS1 PROTEIN VORLÄUFER |
| 47 | 48 | RXN03040 | VV0018 | 761 | 1069 | PS1 PROTEIN VORLÄUFER |
| 49 | 50 | RXN03051 | VV0022 | 2832 | 3566 | PS1 PROTEIN VORLÄUFER |
| 51 | 52 | RXN03054 | VV0026 | 1906 | 3486 | PS1 PROTEIN VORLÄUFER |
| 53 | 54 | RXN02949 | VV0025 | 31243 | 31575 | PREPROTEIN TRANSLOKASE SECE UNTEREINHEIT |
| 55 | 56 | RXN02462 | VV0124 | 11932 | 13749 | PREPROTEIN TRANSLOKASE SECA UNTEREINHEIT |
| 57 | 58 | RXN01559 | VV0171 | 7795 | 5954 | PROTEIN-EXPORT MEMBRANE PROTEIN SECD |
| 59 | 60 | RXN00046 | VV0119 | 5363 | 6058 | Signal Erkennung particle GTPase |
| 61 | 62 | RXN01863 | VV0206 | 1172 | 24 | /O/C Thioredoxin-ähnliche oxidoreductase |
| 63 | 64 | RXN00833 | VV0180 | 8039 | 8533 | THIOL PEROXIDASE (EC 1.11.1.-) |
| 65 | 66 | RXN01676 | VV0179 | 12059 | 11304 | THIOL:DISULFIDE AUSTAUSCH PROTEIN DSBD |
| 67 | 68 | RXN00380 | VV0223 | 836 | 216 | THIOL:DISULFIDE AUSTAUSCH PROTEIN TLPA |
| 69 | 70 | RXN00937 | VV0079 | 42335 | 42706 | THIOREDOXIN |
| 71 | 72 | RXN02325 | VV0047 | 5527 | 6393 | THIOREDOXIN |
| 73 | 74 | RXN01837 | VV0320 | 7103 | 7879 | PEPTIDYL-PROLYL CIS-TRANS ISOMERASE (EC 5.2.1.8) |
| 75 | 76 | RXN01926 | VV0284 | 1 | 741 | PEPTID KETTE RELEASE FACTOR 3 |
| 77 | 78 | RXN02002 | VV0111 | 141 | 518 | PEPTID KETTE RELEASE FACTOR 3 |
| 79 | 80 | RXN02736 | VV0074 | 13600 | 14556 | PUTATIVES OXPPCYCLE PROTEIN OPCA |
| 81 | 82 | RXS03217 | | | | SMALL COLD-SHOCK PROTEIN |
| 83 | 84 | F RXA01917 | GR00549 | 3465 | 3665 | SMALL COLD-SHOCK PROTEIN |

TABLE 1-continued

| Nucleic Acid SEQ ID NO | Amino Acid SEQ ID NO | Identification Code | Contig. | NT Start | NT Stop | Function |
|---|---|---|---|---|---|---|
| | | | | | | Proteins involved in stress responses |
| 85 | 86 | RXA02184 | GR00641 | 19628 | 19248 | COLD SHOCK-LIKE PROTEIN CSPC |
| 87 | 88 | RXA00810 | GR00218 | 792 | 992 | SMALL COLD-SHOCK PROTEIN |
| 89 | 90 | RXA01674 | GR00467 | 1878 | 2771 | PROBABLE HYDROGEN PEROXIDE-INDUCIBLE GENES ACTIVATOR |
| 91 | 92 | RXA02431 | GR00708 | 2 | 1192 | damage-inducible protein P |
| 93 | 94 | RXA02446 | GR00709 | 11640 | 11206 | OSMOTICALLY INDUCIBLE PROTEIN C |
| 95 | 96 | RXA02861 | GR10006 | 551 | 1633 | probable metallothlonein u0308aa - *Mycobacterium leprae* |
| 97 | 98 | RXA00981 | GR00276 | 3388 | 4017 | GTP PYROPHOSPHOKINASE (EC 2.7.6.5) |
| 99 | 100 | RXN00786 | VV0321 | 1680 | 706 | LYTB PROTEIN |
| 101 | 102 | RXS01027 | VV0143 | 5761 | 6768 | DIADENOSINE 5',5'''-P1,P4-TETRAPHOSPHATE HYDROLASE (EC 3.6.1.17) |
| 103 | 104 | RXS01528 | VV0050 | 17276 | 16749 | DIADENOSINE 5',5'''-P1,P4-TETRAPHOSPHATE HYDROLASE (EC 3.6.1.17) |
| 105 | 106 | RXS01716 | VV0319 | 3259 | 2774 | EXOPOLYPHOSPHATASE (EC 3.6.1.11) |
| 107 | 108 | RXS01835 | VV0143 | 10575 | 10045 | GUANOSINE-3',5'-BIS(DIPHOSPHATE) 3'-PYROPHOSPHOHYDROLASE (EC 3.1.7.2) |
| 109 | 110 | RXS02497 | VV0007 | 15609 | 16535 | EXOPOLYPHOSPHATASE (EC 3.6.1.11) |
| 111 | 112 | RXS02972 | VV0319 | 2763 | 2353 | EXOPOLYPHOSPHATASE (EC 3.6.1.11) |
| | | | | | | Resistance and tolerance |
| 113 | 114 | RXA02159 | GR00640 | 6231 | 6743 | ARGININE HYDROXIMATE RESISTANCE PROTEIN |
| 115 | 116 | RXA02201 | GR00646 | 5837 | 6199 | ARSENATE REDUCTASE |
| 117 | 118 | RXA00599 | GR00159 | 1843 | 1457 | ARSENICAL-RESISTANCE PROTEIN ACR3 |
| 119 | 120 | RXA00600 | GR00159 | 2940 | 1843 | ARSENICAL-RESISTANCE PROTEIN ACR3 |
| 121 | 122 | RXA02200 | GR00646 | 4651 | 5760 | ARSENICAL-RESISTANCE PROTEIN ACR3 |
| 123 | 124 | RXA02202 | GR00646 | 6278 | 6916 | ARSENICAL-RESISTANCE PROTEIN ACR3 |
| 125 | 126 | RXA02205 | GR00646 | 9871 | 8993 | BACITRACIN RESISTANCE PROTEIN (PUTATIVE UNDECAPRENOL KINASE) (EC 2.7.1.66) |
| 127 | 128 | RXA00900 | GR00245 | 4052 | 3201 | BICYCLOMYCIN RESISTANCE PROTEIN |
| 129 | 130 | RXN00901 | VV0140 | 8581 | 8168 | BICYCLOMYCIN RESISTANCE PROTEIN |
| 131 | 132 | F RXA00901 | GR00245 | 4357 | 3980 | BICYCLOMYCIN RESISTANCE PROTEIN |
| 133 | 134 | RXA00289 | GR00046 | 3263 | 4438 | CHLORAMPHENICOL RESISTANCE PROTEIN |
| 135 | 136 | RXN01984 | VV0056 | 1515 | 1811 | CHLORAMPHENICOL RESISTANCE PROTEIN |
| 137 | 138 | F RXA01984 | GR00574 | 282 | 4 | CHLORAMPHENICOL RESISTANCE PROTEIN |
| 139 | 140 | RXA00109 | GR00015 | 1178 | 565 | COPPER RESISTANCE PROTEIN C PRECURSOR |
| 141 | 142 | RXA00109 | GR00015 | 1176 | 565 | COPPER RESISTANCE PROTEIN C PRECURSOR |
| 143 | 144 | RXA00996 | GR00283 | 1763 | 1023 | DAUNORUBICIN RESISTANCE ATP-BINDING PROTEIN DRRA |
| 145 | 146 | RXN00829 | VV0180 | 7950 | 5611 | DAUNORUBICIN RESISTANCE PROTEIN |
| 147 | 148 | F RXA00829 | GR00224 | 2 | 256 | DAUNORUBICIN RESISTANCE PROTEIN |
| 149 | 150 | F RXA00834 | GR00225 | 463 | 2025 | DAUNORUBICIN RESISTANCE PROTEIN |
| 151 | 152 | RXA00995 | GR00283 | 1023 | 283 | DAUNORUBICIN RESISTANCE TRANSMEMBRANE PROTEIN |
| 153 | 154 | RXN00803 | VV0009 | 53858 | 52629 | METHYLENOMYCIN A RESISTANCE PROTEIN |
| 155 | 156 | F RXA00803 | GR00214 | 4560 | 5162 | METHYLENOMYCIN A RESISTANCE PROTEIN |
| 157 | 158 | RXA01407 | GR00410 | 3918 | 3028 | METHYLENOMYCIN A RESISTANCE PROTEIN |
| 159 | 160 | RXA01408 | GR00410 | 4384 | 4184 | METHYLENOMYCIN A RESISTANCE PROTEIN |
| 161 | 162 | RXN01922 | VV0020 | 2031 | 3182 | METHYLENOMYCIN A RESISTANCE PROTEIN |
| 163 | 164 | F RXA01922 | GR00552 | 3 | 1109 | METHYLENOMYCIN A RESISTANCE PROTEIN |
| 165 | 166 | RXA02060 | GR00626 | 1 | 339 | MYCINAMICIN-RESISTANCE PROTEIN MYRA |
| 167 | 168 | RXN01936 | VV0127 | 40116 | 41387 | MACROLIDE-EFFLUX PROTEIN |
| 169 | 170 | F RXA01936 | GR00555 | 9796 | 8975 | NICKEL RESISTANCE PROTEIN |
| 171 | 172 | F RXA01937 | GR00555 | 10246 | 9821 | NICKEL RESISTANCE PROTEIN |
| 173 | 174 | RXN01010 | VV0209 | 3776 | 4894 | QUINOLONE RESISTANCE NORA PROTEIN |
| 175 | 176 | F RXA01010 | GR00288 | 774 | 4 | QUINOLONE RESISTANCE NORA PROTEIN |
| 177 | 178 | RXN03142 | VV0136 | 5754 | 4612 | QUINOLONE RESISTANCE NORA PROTEIN |
| 179 | 180 | F RXA01150 | GR00323 | 3807 | 2917 | QUINOLONE RESISTANCE NORA PROTEIN |
| 181 | 182 | RXN02964 | VV0102 | 7931 | 6714 | QUINOLONE RESISTANCE NORA PROTEIN |
| 183 | 184 | F RXA02116 | GR00636 | 911 | 6 | QUINOLONE RESISTANCE NORA PROTEIN |
| 185 | 186 | RXA00858 | GR00233 | 1680 | 2147 | TELLURIUM RESISTANCE PROTEIN TERC |
| 187 | 188 | RXA02305 | GR00663 | 2921 | 2070 | DAUNOMYCIN C-14 HYDROXYLASE |
| 189 | 190 | RXA00084 | GR00013 | 2367 | 1543 | VIBRIOBACTIN UTILIZATION PROTEIN VIUB |
| 191 | 192 | RXA00843 | GR00228 | 3236 | 3580 | ARSENATE REDUCTASE |
| 193 | 194 | RXA01052 | GR00296 | 3398 | 3706 | MERCURIC REDUCTASE (EC 1.16.1.1) |
| 195 | 196 | RXA01053 | GR00296 | 3772 | 4191 | MERCURIC REDUCTASE (EC 1.16.1.1) |
| 197 | 198 | RXA01054 | GR00296 | 4229 | 4717 | MERCURIC REDUCTASE (EC 1.16.1.1) |
| 199 | 200 | RXN03123 | VV0106 | 808 | 1245 | HEAVY METAL TOLERANCE PROTEIN PRECURSOR |
| 201 | 202 | F RXA00993 | GR00282 | 641 | 6 | HEAVY METAL TOLERANCE PROTEIN PRECURSOR |
| 203 | 204 | RXA01051 | GR00296 | 3298 | 2690 | VANZ PROTEIN, telcoplanin resistance protein |
| 205 | 206 | RXN01873 | VV0248 | 2054 | 819 | Hypothetical Drug Resistance Protein |
| 207 | 208 | F RXA01873 | GR00535 | 855 | 1946 | Hypothetical Drug Resistance Protein |
| 209 | 210 | RXN00034 | VV0020 | 16933 | 18381 | MULTIDRUG RESISTANCE PROTEIN B |
| 211 | 212 | F RXA02273 | GR00655 | 8058 | 9002 | Hypothetical Drug Resistance Protein |
| 213 | 214 | RXN03075 | VV0042 | 2491 | 3216 | Hypothetical Drug Transporter |

TABLE 1-continued

| Nucleic Acid SEQ ID NO | Amino Acid SEQ ID NO | Identification Code | Contig. | NT Start | NT Stop | Function |
|---|---|---|---|---|---|---|
| 215 | 216 | F RXA02907 | GR10044 | 1395 | 2120 | Hypothetical Drug Transporter |
| 217 | 218 | RXA00479 | GR00119 | 16290 | 14101 | Hypothetical Drug Transporter |
| 219 | 220 | RXN03124 | VV0108 | 4 | 963 | Hypothetical Drug Transporter |
| 221 | 222 | F RXA01180 | GR00336 | 4 | 765 | Hypothetical Drug Transporter |
| 223 | 224 | RXA02586 | GR00741 | 10296 | 10027 | Hypothetical Drug Transporter |
| 225 | 226 | RXA02587 | GR00741 | 12343 | 10253 | Hypothetical Drug Transporter |
| 227 | 228 | RXN03042 | VV0018 | 2440 | 1835 | Hypothetical Drug Transporter |
| 229 | 230 | F RXA02893 | GR10035 | 1841 | 1236 | Hypothetical Drug Transporter |
| 231 | 232 | RXA01616 | GR00450 | 1684 | 203 | MULTIDRUG EFFLUX PROTEIN QACB |
| 233 | 234 | RXA01666 | GR00463 | 2307 | 3683 | MULTIDRUG RESISTANCE PROTEIN |
| 235 | 236 | RXA00082 | GR00009 | 13252 | 11855 | MULTIDRUG RESISTANCE PROTEIN B |
| 237 | 238 | RXA00215 | GR00032 | 13834 | 15294 | MULTIDRUG RESISTANCE PROTEIN B |
| 239 | 240 | RXN03064 | VV0038 | 4892 | 6223 | MULTIDRUG RESISTANCE PROTEIN B |
| 241 | 242 | F RXA00555 | GR00151 | 4892 | 5884 | MULTIDRUG RESISTANCE PROTEIN B |
| 243 | 244 | F RXA02878 | GR10016 | 1837 | 1481 | MULTIDRUG RESISTANCE PROTEIN B |
| 245 | 246 | RXA00648 | GR00169 | 2713 | 1304 | MULTIDRUG RESISTANCE PROTEIN B |
| 247 | 248 | RXN01320 | VV0082 | 13146 | 11500 | MULTIDRUG RESISTANCE PROTEIN B |
| 249 | 250 | F RXA01314 | GR00382 | 744 | 4 | MULTIDRUG RESISTANCE PROTEIN B |
| 251 | 252 | F RXA01320 | GR00383 | 1979 | 1200 | MULTIDRUG RESISTANCE PROTEIN B |
| 253 | 254 | RXN02926 | VV0082 | 11497 | 9866 | MULTIDRUG RESISTANCE PROTEIN B |
| 255 | 256 | F RXA01319 | GR00383 | 1197 | 4 | MULTIDRUG RESISTANCE PROTEIN B |
| 257 | 258 | RXA01578 | GR00439 | 1423 | 29 | MULTIDRUG RESISTANCE PROTEIN B |
| 259 | 260 | RXA02087 | GR00629 | 7076 | 5730 | MULTIDRUG RESISTANCE PROTEIN B |
| 261 | 262 | RXA02088 | GR00629 | 8294 | 7080 | MULTIDRUG RESISTANCE PROTEIN B |
| 263 | 264 | RXA00764 | GR00204 | 3284 | 2169 | BMRU PROTEIN *Bacillus subtilis* bmrU, multidrug efflux transporter |
| 265 | 266 | RXN03125 | VV0108 | 972 | 1142 | Hypothetical Drug Transporter |
| 267 | 268 | RXN01553 | VV0135 | 25201 | 26520 | Hypothetical Drug Permease |
| 269 | 270 | RXN00535 | VV0219 | 5155 | 5871 | Hypothetical Drug Resistance Protein |
| 271 | 272 | RXN00453 | VV0076 | 1173 | 3521 | Hypothetical Drug Transporter |
| 273 | 274 | RXN00932 | VV0171 | 13120 | 13593 | Hypothetical Drug Transporter |
| 275 | 276 | RXN03022 | VV0002 | 65 | 511 | MULTIDRUG RESISTANCE PROTEIN B |
| 277 | 278 | RXN03151 | VV0163 | 489 | 4 | MYCINAMICIN-RESISTANCE PROTEIN MYRA |
| 279 | 280 | RXN02832 | VV0358 | 547 | 5 | LYSOSTAPHIN IMMUNITY FACTOR |
| 281 | 282 | RXN00165 | VV0232 | 3275 | 1860 | MULTIDRUG RESISTANCE-LIKE ATP-BINDING PROTEIN MDL |
| 283 | 284 | RXN01190 | VV0169 | 8992 | 10338 | MULTIDRUG RESISTANCE-LIKE ATP-BINDING PROTEIN MDL |
| 285 | 286 | RXN01102 | VV0059 | 6128 | 4884 | QUINOLONE RESISTANCE NORA PROTEIN |
| 287 | 288 | RXN00788 | VV0321 | 3424 | 3648 | CHLORAMPHENICOL RESISTANCE PROTEIN |
| 289 | 290 | RXN02119 | VV0102 | 11242 | 9602 | A201A-RESISTANCE ATP-BINDING PROTEIN |
| 291 | 292 | RXN01605 | VV0137 | 7124 | 5610 | DAUNORUBICIN RESISTANCE TRANSMEMBRANE PROTEIN |
| 293 | 294 | RXN01091 | VV0326 | 567 | 4 | MAZG PROTEIN |
| 295 | 296 | RXS02979 | VV0149 | 2150 | 2383 | MERCURIC TRANSPORT PROTEIN PERIPLASMIC COMPONENT PRECURSOR |
| 297 | 298 | RXS02987 | VV0234 | 527 | 294 | MERCURIC TRANSPORT PROTEIN PERIPLASMIC COMPONENT PRECURSOR |
| 299 | 300 | RXS03095 | VV0057 | 4056 | 4424 | CADMIUM EFFLUX SYSTEM ACCESSORY PROTEIN HOMOLOG |

| GenBank ™ Accession No. | Gene Name | Gene Function | Reference |
|---|---|---|---|
| A09073 | ppg | Phosphoenol pyruvate carboxylase | Bachmann, B. et al. "DNA fragment coding for phosphoenolpyruvat corboxylase, recombinant DNA carrying said fragment, strains carrying the recombinant DNA and method for producing L-aminino acids using said strains," Patent: EP 0358940-A 3 Mar. 21, 1990 |
| A45579, A45581, A45583, A45585, A45587 | | Threonine dehydratase | Moeckel, B. et al. "Production of L-isoleucine by means of recombinant micro-organisms with deregulated threonine dehydratase," Patent: WO 9519442-A 5 Jul. 20, 1995 |
| AB003132 | murC; ftsQ; ftsZ | | Kobayashi, M. et al. "Cloning, sequencing, and characterization of the ftsZ gene from coryneform bacteria," Biochem. Biophys. Res. Commun., 236(2):383–388 (1997) |
| AB015023 | murC; ftsQ | | Wachi, M. et al. "A murC gene from *Coryneform* bacteria," Appl. Microbiol. Biotechnol., 51(2):223–228 (1999) |

-continued

| GenBank™ Accession No. | Gene Name | Gene Function | Reference |
|---|---|---|---|
| AB018530 | dtsR | | Kimura, E. et al. "Molecular cloning of a novel gene, dtsR, which rescues the detergent sensitivity of a mutant derived from *Brevibacterium lactofermenium*," Biosci. Biotechnol. Biochem., 60(10):1565–1570 (1996) |
| AB018531 | dtsR1; dtsR2 | | |
| AB020624 | murI | D-glutamate racemase | |
| AB023377 | tkt | transketolase | |
| AB024708 | gltB; gltD | Glutamine 2-oxoglutarate aminotransferase large and small subunits | |
| AB025424 | acn | aconitase | |
| AB027714 | rep | Replication protein | |
| AB027715 | rep; aad | Replication protein; aminoglycoside adenyltransferase | |
| AF005242 | argC | N-acetylglutamate-5-semialdehyde dehydrogenase | |
| AF005635 | glnA | Glutamine synthetase | |
| AF030405 | hisF | cyclase | |
| AF030520 | argG | Argininosuccinate synthetase | |
| AF031518 | argF | Ornithine carbamolytransferase | |
| AF036932 | aroD | 3-dehydroquinate dehydratase | |
| AF038548 | pyc | Pyruvate carboxylase | |
| AF038651 | dciAE; apt; rel | Dipeptide-binding protein; adenine phosphoribosyltransferase; GTP pyrophosphokinase | Wehmeier, L. et al. "The role of the *Corynebacterium glutamicum* rel gene in (p)ppGpp metabolism," Microbiology. 144:1853–1862 (1998) |
| AF041436 | argR | Arginine repressor | |
| AF045998 | impA | Inositol monophosphate phosphatase | |
| AF048764 | argH | Argininosuccinate lyase | |
| AF049897 | argC; argJ; argB; argD; argF; argR; argG; argH | N-acetylglutamylphosphate reductase; ornithine acetyltransferase; N-acetylglutamate kinase; acetylornithine transminase; ornithine carbamoyltransferase; arginine repressor; argininosuccinate synthase; argininosuccinate lyase | |
| AF050109 | inhA | Enoyl-acyl carrier protein reductase | |
| AF050166 | hisG | ATP phosphoribosyltransferase | |
| AF051846 | hisA | Phosphoribosylformimino-5-amino-1-phosphoribosyl-4-imidazolecarboxamide isomerase | |
| AF052652 | metA | Homoserine O-acetyltransferase | Park, S. et al. "Isolation and analysis of metA, a methionine biosynthetic gene encoding homoserine acetyltransferase in *Corynebacterium glutamicum*," Mol. Cells, 8(3):286–294 (1998) |
| AF053071 | aroB | Dehydroquinate synthetase | |
| AF060558 | hisH | Glutamine amidotransferase | |
| AF086704 | hisE | Phosphoribosyl-ATP-pyrophosphohydrolase | |
| AF114233 | aroA | 5-enolpyruvylshikimate 3-phosphate synthase | |
| AF116184 | panD | L-aspartate-alpha-decarboxylase precursor | Dusch, N. et al. "Expression of the *Corynebacterium glutamicum* panD gene encoding L-aspartate-alpha-decarboxylase leads to pantothenate overproduction in *Escherichia coli*," Appl. Environ. Microbiol., 65(4)1530–1539 (1999) |
| AF124518 | aroD; aroE | 3-dehydroquinase; shikimate dehydrogenase | |
| AF124600 | aroC; aroK; aroB; pepQ | Chorismate synthase; shikimate kinase; 3-dehydroquinate synthase; putative cytoplasmic peptidase | |
| AF145897 | inhA | | |
| AF145898 | inhA | | |
| AJ001436 | ectP | Transport of ectoine, glycine betaine, proline | Peter, H. et al. "*Corynebacterium glutamicum* is equipped with four secondary carriers for compatible solutes: Identification, sequencing, and characterization of the proline/ectoine, uptake system, ProP, and the ectoine/proline/glycine betaine carrier, EctP," J. Bacteriol., 180(22):6005–6012 (1998) |
| A1004934 | dapD | Tetrahydrodipicolinate succinylase (incomplete[i]) | Wehrmann, A. et al. "Different modes of diaminopimelate synthesis and their role in cell wall integrity: A study with *Corynebacterium glutamicum*," J. Bacteriol., 180(12):3159–3165 (1998) |
| AJ007732 | ppc; secG; amt; ocd; soxA | Phosphoenolpyruvate-carboxylase; ?; high affinity ammonium uptake protein; putative ornithine-cyclodecarboxylase; sarcosine oxidase | |
| AJ010319 | ftsY, glnB, glnD; srp; amtP | Involved in cell division; PII protein; uridylyltransferase (uridylyl-removing enzmye); signal recognition particle; low affinity ammonium uptake protein | Jakoby, M. at al. "Nitrogen regulation in *Corynebacterium glutamicum*; Isolation of genes involved in biochemical characterization of corresponding proteins," FEMS Microbiol., 173(2):303–310 (1999) |
| AJ132968 | cat | Chloramphenicol aceteyl transferase | |

-continued

| GenBank™ Accession No. | Gene Name | Gene Function | Reference |
|---|---|---|---|
| AJ224946 | mqo | L-malate: quinone oxidoreductase | Molenaar, D. et al. "Biochemical and genetic characterization of the membrane-associated malate dehydrogenase (acceptor) from *Corynebacterium glutamicum*," Eur. J. Biochem., 254(2):395–403 (1998) |
| AJ238250 | ndh | NADH dehydrogenase | |
| AJ238703 | porA | Porin | Lichtinger, T. et al. "Biochemical and biophysical characterization of the cell wall porin of *Corynebacterium glutamicum*: The channel is formed by a low molecular mass polypeptide," Biochemistry, 37(43):15024–15032 (1998) |
| D17429 | | Transposable element IS31831 | Vertes, A. A. et al. "Isolation and characterization of IS31831, a transposable element from *Corynebacterium glutamicum*," Mol. Microbiol., 11(4):739–746 (1994) |
| D84102 | odhA | 2-oxoglutarate dehydrogenase | Usuda, Y. et al. "Molecular cloning of the *Corynebacterium glutamicum* (*Brevibacterium lactofermentum* AJ12036) odhA gene encoding a novel type of 2-oxoglutarate dehydrogenase," Microbiology, 142:3347–3354 (1996) |
| E01358 | hdh; hk | Homoserine dehydrogenase; homoserine kinase | Katsumata, R. et al. "Production of L-thereonine and L-isoleucine," Patent: JP 1987232392-A 1 Oct. 12, 1987 |
| E01359 | | Upstream of the start codon of homoserine kinase gene | Katsumata, R. et al. "Production of L-thereonine and L-isoleucine," Patent: JP 1987232392-A2 Oct. 12, 1987 |
| E01375 | | Tryptophan operon | |
| E01376 | trpL; trpE | Leader peptide; anthranilate synthase | Matsui, K. et al. "Tryptophan operon, peptide and protein coded thereby, utilization of tryptophan operon gene expression and production of tryptophan," Patent: JP 1987244382-A 1 Oct. 24, 1987 |
| E01377 | | Promoter and operator regions of tryptophan operon | Matsui, K. et al. "Tryptophan operon, peptide and protein coded thereby, utilization of tryptophan operon gene expression and production of tryptophan," Patent: JP 1987244382-A 1 Oct. 24, 1987 |
| E03937 | | Biotin-synthase | Hatakeyama, K. et al. "DNA fragment containing gene capable of coding biotin synthetase and its utilization," Patent: JP 1992278088-A 1 Oct. 2, 1992 |
| E04040 | | Diamino pelargonic acid aminotransferase | Kohama, K. et al. "Gene coding diaminopelargonic acid aminotransferase and desthiobiotin synthetase and its utilization," Patent: JP 1992330284-A 1 Nov. 18, 1992 |
| E04041 | | Desthiobiotinsynthetase | Kohama, K. et al. "Gene coding diaminopelargonic acid aminotransferase and desthiobiotin synthetase and its utilization," Patent: JP 1992330284-A 1 Nov. 18, 1992 |
| E04307 | | Flavum aspartase | Kurusu, Y. et al. "Gene DNA coding aspartase and utilization thereof," Patent: JP 1993030977-A 1 Feb. 9, 1993 |
| E04376 | | Isocitric acid lyase | Katsumata, R. et al. "Gene manifestation controlling DNA," Patent: JP 1993056782-A 3 Mar. 9, 1993 |
| E04377 | | Isocitric acid lyase N-terminal fragment | Katsumata, R. et al. "Gene manifestation controlling DNA," Patent: JP 1993056782-A 3 Mar. 9, 1993 |
| E04484 | | Prephenate dehydratase | Sotouchi, N. et al. "Production of L-phenylalanine by fermentation," Patent: JP 1993076352-A 2 Mar. 30, 1993 |
| E05108 | | Aspartokinase | Fugono, N. et al. "Gene DNA coding Aspartokinase and its use," Patent: JP 1993184366-A 1 Jul. 27, 1993 |
| E05112 | | Dihydro-dipichorinate synthetase | Hatakeyama, K. et al. "Gene DNA coding dihydrodipicolinic acid synthetase and its use," Patent: JP 1993184371-A Jul. 27, 1993 |
| E05776 | | Diaminopimelic acid dehydrogenase | Kobayashi, M. et al. "Gene DNA coding Diaminopimelic acid dehydrogenase and its use," Patent: JP 1993284970-A 1 Nov. 2, 1993 |
| E05779 | | Threonine synthase | Kohama, K. et al. "Gene DNA coding threonine synthase and its use," Patent: JP 1993284972-A 1 Nov. 2, 1993 |
| E06110 | | Prephenate dehydratase | Kikuchi, T. et al. "Production of L-phenylalanine by fermentation method," Patent: JP 1993344881-A 1 Dec. 27, 1993 |
| E06111 | | Mutated Prephenate dehydratase | Kikuchi, T. et al. "Production of L-phenylalanine by fermentation method," Patent: JP 1993344881-A 1 Dec. 27. 1993 |
| E06146 | | Acetohydroxy acid synthetase | Inui, M. et al. "Gene capable of coding Acetohydroxy acid synthetase and its use," Patent: JP 1993344893-A 1 Dec. 27, 1993 |
| E06825 | | Aspartokinase | Sugimoto, M. et al. "Mutant aspartokinase gene," patent: JP 1994062866-A 1 Mar. 8, 1994 |
| E06826 | | Mutated aspartokinase alpha subunit | Sugimoto, M. et al. "Mutant aspartokinase gene," patent: JP 1994062866-A 1 Mar. 8, 1994 |
| E06827 | | Mutated aspartokinase alpha subunit | Sugimoto, M. et al. "Mutant aspartokinase gene," patent: JP 1994062866-A 1 Mar. 8, 1994 |
| E07701 | secY | | Honno, N. et al. "Gene DNA participating in integration of membraneous protein to membrane," Patent: JP 1994169780-A 1 Jun. 21, 1994 |
| E08177 | | Aspartokinase | Sato, Y. et al. "Genetic DNA capable of coding Aspartokinase released from feedback inhibition and its utilization," Patent: JP 1994261766-A 1 Sep. 20, 1994 |
| E08178, E08179, E08180, E08181, E08182 | | Feedback inhibition-released Aspartokinase | Sato, Y. et al. "Genetic DNA capable of coding Aspartokinase released from feedback inhibition and its utilization," Patent: JP 1994261766-A 1 Sep. 20, 1994 |
| E08232 | | Acetohydroxy-acid isomeroreductase | Inui, M. et al. "Gene DNA coding acetohydroxy acid isomeroreductase," Patent: JP 1994277067-A 1 Oct. 4, 1994 |
| E08234 | secE | | Asai, Y. et al. "Gene DNA A coding for translocation machinery of protein," Patent: JP 1994277073-A 1 Oct. 4, 1994 |

-continued

| GenBank™ Accession No. | Gene Name | Gene Function | Reference |
|---|---|---|---|
| E08643 | | FT aminotransferase and desthiobiotin synthetase promoter region | Hatakeyama, K. et al. "DNA fragment having promoter function in coryneform bacterium," Patent: JP 199503476-A 1 Feb. 3, 1995 |
| E08646 | | Biotin synthetase | Hatakeyama, K. et al. "DNA fragment having promoter function in coryneform bacterium," Patent: JP 1995031476-A 1 Feb. 3, 1995 |
| E08649 | | Aspartase | Kohama, K. et al "DNA fragment having promoter function in coryneform bacterium," Patent: JP 1995031478-A Feb. 3, 1995 |
| E08900 | | Dihydrodipicolinate reductase | Madori, M. et al. "DNA fragment containing gene coding Dihyrodipicolinate acid reductase and utilization thereof," Patent: JP 1995075578.A 1 Mar. 20, 1995 |
| E08901 | | Diaminopimelic acid decarboxylase | Madori, M. et al. "DNA fragment containing gene coding Diaminopimelic acid decarboxylase and utilization thereof," Patent. JP 1995075579-A 1 Mar. 20, 1995 |
| E12594 | | Serine hydroxymethyltransferase | Hatakeyama, K. et al. "Production of L-trypophan," Patent: JP 1997028391-A 1 Feb. 4, 1997 |
| E12760, E12759, E12758 | | transposase | Moriya, M. et al. "Amplification of gene using artificial transposon," Patent: JP 199707029J-A Mar. 18, 1997 |
| E12764 | | Arginyl-tRNA synthetase; diaminopimelic acid decarboxylase | Moriya, M. et al. "Amplification of gene using artificial transposon," Patent JP 1997070291-A Mar. 18, 1997 |
| E12767 | | Dihydrodipicolinic acid synthetase | Moriya, M. et al. "Amplification of gene using artificial transposon," Patent: JP 1997070291-A Mar. 18, 1997 |
| E12770 | | aspartokinase | Moriya, M. et al. "Amplification of gene using artificial transposon," Patent: JP 1997070291-A Mar. 18, 1997 |
| E12773 | | Dihydrodipicolinic acid reductase | Moriya, M. et al. "Amplification of gene using artificial transposon," Patent: JP 1997070291-A Mar. 18, 1997 |
| E13655 | | Glucose-6-phosphate dehydrogenase | Hatakeyama, K. et al. "Glucose-6-phosphate dehydrogenase and DNA capable of coding the same," Patent: JP 1997224661-A Sep. 2, 1997 |
| L01508 | IlvA | Threonine dehydratase | Moeckel, B. et al. "Functional and structural analysis of the threonine dehydratase of *Corynebacterium glutamicum*," J Bacteriol., 174:8065–8072 (1992) |
| L07603 | EC 4.2.1.15 | 3-deoxy-D-arabinoheptulosonate-7-phosphate synthase | Chen, C. et al. "The cloning and nucleotide sequence of *Corynebacterium glutamicum* 3-deoxy-D-arabinoheptulosonate-7-phosphate synthase gene," FEMS Microbiol. Lett., 107:223–230 (1993) |
| L09232 | IlvB; ilvN; ilvC | Acetohydroxy acid synthase large subunit; Acetohydroxy acid synthase small subunit; Acetohydroxy acid isomeroreductase | Keilhauer, C. et al. "Isoleucine synthesis in *Corynebacterium glutamicum*: molecular analysis of the ilvB-ilvN-ilvC operon," J. Bacteriol., 175(17):5595–5603 (1993) |
| L18874 | PtsM | Phosphoenolpyruvate sugar phosphotransferase | Fouet, A et al. "*Bacillus subtilis* sucrose-specifi3c enzyme II of the phosphotransferase system: expression in *Escherichia coli* and homology to enzymes II from enteric bacteria," PNAS USA, 84(24):8773–8777 (1987); Lee, J. K. et al. "Nucleotide sequence of the gene encoding the *Corynebacterium glutamicum* mannose enzyme II and analyses of the deduced protein sequence," FEMS Microbial. Lett., 119(1–2):137–145 (1994) |
| L27123 | aceB | Malate synthase | Lee, H-S. et al. "Molecular characterization of aceB, a gene encoding malate synthase in *Corynebacterium glutamicum*," J. Microbiol. Biotechnol., 4(4):256–263 (1994) |
| L27126 | | Pyruvate kinase | Jetten, M. S. et al. "Structural and functional analysis of pyruvate kinase from *Corynebacterium glutamicum*," Appl. Environ. Microbiol., 60(7):2501–2507 (1994) |
| L28760 | aceA | Isocitrate lyase | |
| L35906 | dtxr | Diphtheria toxin repressor | Oguiza, J. A. et al. "Molecular cloning, DNA sequence analysis, and characterization of the *Corynebacterium diphtheriae* dtxR from *Brevibacterium lactofermentum*," J. Bacieriol., 177(2):465–467 (1995) |
| M13774 | | Prephenate dehydratase | Follettie, M. T. et at. "Molecular cloning and nucleotide sequence of the *Corynebacterium glutamicum* pheA gene," J. Bacteriol., 167:695–702 (1986) |
| M16175 | 5S rRNA | | Park, Y-H. et al. "Phylogenetic analysis of the coryneform bacteria by 56 rRNA sequences," J. Bacteriol, 169:1801–1806 (1987) |
| M16663 | trpE | Anthranilate synthase, 5' end | Sano, K. et al. "Structure and function of the trp operon control regions of *Brevibacterium lactofermentum*, a glutamic-acid-producing bacterium," Gene, 52:191–200 (1987) |
| M16664 | trpA | Tryptophan synthase, 3' end | Sano, K. et al a). "Structure and function of the trp operon control regions of *Brevibacterium lactofermentum*, a glutamic-acid-producing bacterium," Gene, 52:191–200 (1987) |
| M25819 | | Phosphoenolpyruvate carboxylase | O'Regan, M. et al. "Cloning and nucleotide sequence of the Phosphoenolpyruvate carboxylase-coding gene of *Corynebacterium glutamicum* ATCC13032," Gene, 77(2):237–251 (1989) |
| M85106 | | 23S rRNA gene insertion sequence | Roller, C. et al. "Gram-positive bacteria with a high DNA G + C content are characterized by a common insertion within their 23S rRNA genes," J. Gen. Microbiol., 138:1167–1175 (1992) |
| M85107, M85108 | | 23S rRNA gene insertion sequence | Roller, C. et al. "Gram-positive bacteria with a high DNA G + C content are characterized by a common insertion within their 23S rRNA genes," J. Gen. Microbiol., 138:1167–1175 (1992) |

-continued

| GenBank™ Accession No. | Gene Name | Gene Function | Reference |
|---|---|---|---|
| M89931 | aecD; brnQ; yhbw | Beta C-S lyase; branched-chain amino acid uptake carrier; hypothetical protein yhbw | Rossol, I. et at. "The *Corynebacterium glutamicum* aecD gene encodes a C-S lyase with alpha, beta-elimination activity that degrades aminoethylcysteine," J. Bacteriol., 174(9):2968–2977 (1992); Tauch, A. et al. "Isoleucine uptake in *Corynebacterium glutamicum* ATCC 13032 is directed by the brnQ gene product," Arch. Microbiol., 169(4):303–312 (1998) |
| S59299 | trp | Leader gene (promoter) | Herry, D. M. et al. "Cloning of the trp gene cluster from a tryptophan-hyperproducing strain of *Corynebacterium glutamicum*: identification of a mutation in the trp leader sequence," Appl. Environ. Microbiol., 59(3):791–799 (1993) |
| U11545 | trpD | Anthranitate phosphoribosyltransferase | O'Gara, J. P. and Dunican, L. K. (1994) Complete nucleotide sequence of the *Corynebacterium glutamicum* ATCC 21850 tpD gene:" Thesis, Microbiology Department, University College Galway, Ireland |
| U13922 | cgIIM; cgIIR; clgIIR | Putative type II 5-cytosoine methyltransferase; putative type II restriction endonuclease; putative type I or type III restriction endonuclease | Schafer, A. et al. "Cloning and characterization of a DNA region encoding a stress-sensitive restriction system from *Corynebacterium glutamicum* ATCC 13032 and analysis of its rote in intergeneric conjugation with *Escherichia coli*," J. Bacteriol., 176(23):7309–7319 (1994); Schafer, A. et al. "The *Corynebacterium glutamicum* cgIIM gene encoding a 5-cytosine in an McrBC-deficient *Escherichia coli* strain," Gene, 203(2):95–101 (1997) |
| U14965 | recA | | |
| U31224 | ppx | | Ankri, S. et al. "Mutations in the *Corynebacterium glutamicum* proline biosynthetic pathway: A natural bypass of the proA step," J. Bacteriol., 178(15):4412–4419 (1996) |
| U31225 | proC | L-proline: NADP+ 5-oxidoreductase | Ankri, S. et al. "Mutations in the *Corynebacterium glutamicum* proline biosynthetic pathway: A natural bypass of the proA step," J. Bacteriol., 178(15):4412–4419 (1996) |
| U31230 | obg; proB; unkdh | ?; gamma glutamyl kinase; similar to D-isomer specific 2-hydroxyacid dehydrogenases | Ankri, S. et al. "Mutations in the *Corynebacterium glutamicum* proline biosynthetic pathway: A natural bypass of the proA step," J. Bacteriol., 178(15):4412–4419 (1996) |
| U31281 | bioB | Biotin synthase | Serebriiskii, I. G., "Two new members of the bio B superfamily: Cloning, sequencing and expression of bio B genes of Methylobacillus flagellatum and *Corynebacterium glutamicum*," Gene, 175:15–22 (1996) |
| U35023 | thtR; accBC | Thiosulfate sulfurtransferase; acyl CoA carboxylase | Jager, W. et al. "A *Corynebacterium glutamicum* gene encoding a two-domain protein similar to biotin carboxylases and biotin-carboxyl-carrier proteins," Arch. Microbiol., 166(2);76–82 (1996) |
| U43535 | cmr | Multidrug resistance protein | Jager, W. et al. "A *Corynebacterium glutamicum* gene conferring multidrug resistance in the heterologous host *Escherichia coli*," J. Bacteriol., 179(7):2449–2451 (1997) |
| U43536 | clpB | Heat shock ATP-binding protein | |
| U53587 | aphA-3 | 3'5"-aminoglycoside phosphotransferase | |
| U89648 | | *Corynebacterium glutamicum* unidentified sequence involved in histidine biosynthesis, partial sequence | |
| X04960 | trpA; trpB; trpC; trpD; trpE; trpG; trpL | Tryptophan operon | Matsui, K. et al. "Complete nucleotide and deduced amino acid sequences of the *Brevibacterium lactofermentum* tryptophan operon," Nucleic Acids Res., 14(24):10113–10114 (1986) |
| X07563 | lys A | DAP decarboxylase (meso-diaminopimelate decarboxylase, EC 4.1.1.20) | Yeh, P. et al. "Nucleic sequence of the lysA gene of *Corynebacterium glutamicum* and possible mechanisms for modulation of its expression," Mol. Gen. Genet., 212(1):112–119 (1988) |
| X14234 | EC 4.1.1.31 | Phosphoenolpyruvate carboxylase | Eikmanns, B. J. et al. "The Phosphoenolpyruvate carboxylase gene of *Corynebacterium glutamicum*: Molecular cloning, nucleotide sequence, and expression," Mol. Gen. Genet., 218(2):330–339 (1989); Lepiniec, L. et al. "Sorghum Phosphoenolpyruvate carboxylase gene family: structure, function and molecular evolution," Plant. Mol. Biol., 21 (3):487–502 (1993) |
| X17313 | fda | Fructose-bisphosphate aldolase | Von der Osten, C. H. et al. "Molecular cloning, nucleotide sequence and fine-structural analysis of the *Corynebacterium glutamicum* fda gene: structural comparison of *C. glutamicum* fructose-1,6-biphosphate aldolase to class I and class II aldolases," Mol. Microbiol., |
| X53993 | dapA | L-2,3–dihydrodipicolinate synthetase (EC 4.2.1.52) | Bonnassie, S. et al. "Nucleic sequence of the dapA gene from *Corynebacterium glutamicum*," Nucleic Acids Res., 18(21):6421 (1990) |
| X54223 | | AttB-related site | Cianciotto, N. et al. "DNA sequence homology between art B-related sites of *Corynebacterium diphtheriae*, *Corynebacterium ulcerans*, *Corynebacterium glutamicum*, and the attP site of lambdacorynephage," FEMS. Microbiol, Lett., 66:299–302 (1990) |
| X54740 | argS; lysA | Arginyl-tRNA synthetase; Diaminopimelate decarboxylase | Marcel, T. et al. "Nucleotide sequence and organization of the upstream region of the *Corynebacterium glutamicum* lysA gene," Mol. Microbiol., 4(11):1819–1830 (1990) |
| X55994 | trpL; trpE | Putative leader peptide; anthranilate synthase component 1 | Heery, D. M. et al. "Nucleotide sequence of the *Corynebacterium glutamicum* trpE gene," Nucleic Acids Res., 18(23):7138 (1990) |
| X56037 | thrC | Threonine synthase | Han, K. S. et al. "The molecular structure of the *Corynebacterium glutamicum* threonine synthase gene," Mol. Microbiol., 4(10):1693–1702 (1990) |

-continued

| GenBank™ Accession No. | Gene Name | Gene Function | Reference |
|---|---|---|---|
| X56075 | attB-related site | Attachment site | Cianciotto, N. et al. "DNA sequence homology between au B-related sites of *Corynebacterium diphtheriae*, *Corynebacterium ulcerans*, *Corynebacterium glutamicum*, and the attP site of lambdacorynephage," FEMS. Microbiol, Lett., 66:299–302 (1990) |
| X57226 | lysC-alpha; lysC-beta; asd | Aspartokinase-alpha subunit; Aspartokinase-beta subunit; aspartate beta semialdehyde dehydrogenase | Kalinowski, J. et al. "Genetic and biochemical analysis of the Aspartokinase from *Corynebacterium glutamicum*," Mol. Microbiol., 5(5):1197–1204 (1991); Kalinowski, J. et al. "Aspartokinase genes lysC alpha and lysC beta overlap and are adjacent to the aspertate beta-semialdehyde dehydrogenase gene asd in *Corynebacterium glutamicum*," Mol. Gen. Genet., 224(3):317–324 (1990) |
| X59403 | gap; pgk; tpi | Glyceraldehyde-3-phosphate; phosphoglycerate kinase; triosephosphate isomerase | Eikmanns, B. J. "Identification, sequence analysis, and expression of a *Corynebacterium glutamicum* gene cluster encoding the three glycolylic enzymes glyceraldehyde-3-phosphate dehydrogenase, 3-phosphoglycerate kinase, and triosephosphate isomeras," J. Bacteriol., 174(19):6076–6086 (1992) |
| X59404 | gdh | Glutamate dehydrogenase | Bormann, E. R. et al. "Molecular analysis of the *Corynebacterium glutamicum* gdh gene encoding glutamate dehydrogenase," Mol. Microbiol., 6(3):317–326 (1992) |
| X60312 | lysI | L-lysine permease | Seep-Feldhaus, A. H. et al. "Molecular analysis of the *Corynebacterium glutamicum* lysI gene involved in lysine uptake," Mol. Microbiol., 5(12):2995–3005 (1991) |
| X66078 | cop1 | Ps1 protein | Joliff, G. et al. "Cloning and nucleotide sequence of the csp1 gene encoding PS1, one of the two major secreted proteins of *Corynebacterium glutamicum*: The deduced N-terminal region of PS1 is similar to the Mycobacterium antigen 85 complex," Mol. Microbiol., 6(16):2349–2362 (1992) |
| X66112 | glt | Citrate synthase | Eikmanns, B. J. et al. "Cloning sequence, expression and transcriptional analysis of the *Corynebacterium glutamicum* gltA gene encoding citrate synthase," Microbiol., 140:1817–1828 (1994) |
| X67737 | dapB | Dihydrodipicolinate reductase | |
| X69103 | csp2 | Surface layer protein PS2 | Peyret, J. L. et al. "Characterization of the cspB gene encoding PS2, an ordered surface-layer protein in *Corynebacterium glutamicum*," Mol. Microbiol., 9(1):97–109 (1993) |
| X69104 | | IS3 related insertion element | Bonamy, C. et al. "Identification of IS1206, a *Corynebacterium glutamicum* IS3-related insertion sequence and phylogenetic analysis," Mol. Microbiol., 14(3):571–581 (1994) |
| X70959 | leuA | Isopropylmalate synthase | Patek, M. et al. "Leucine synthesis in *Corynebacterium glutamicum*: enzyme activities, structure of leuA, and effect of leuA inactivation on lysine synthesis," Appl. Environ. Microbiol., 60(1):133–140 (1994) |
| X71489 | icd | Isocitrate dehydrogenase (NADP+) | Eikmanns, B. J. et al. "Cloning sequence analysis, expression, and inactivation of the *Corynebacterium glutamicum* icd gene encoding isocitrate dehydrogenase and biochemical characterization of the enzyme," J. Bacteriol., 77(3):774–782 (1995) |
| X72855 | GDHA | Glutamate dehydrogenase (NADP+) | |
| X75083, X70584 | mtrA | 5-methyltryptophan resistance | Heery, D. M. et al. "A sequence from a tryptophan-hyperproducing strain of *Corynebacterium glutamicum* encoding resistance to 5-methyltryptophan," Biochem. Biophys. Res. Commun., 201(3):1255–1262 (1994) |
| X75085 | recA | | Fitzpatrick, R. et al. "Construction and characterization of recA mutant strains of *Corynebacterium glutamicum* and *Brevibacterium lactofermentum*," Appl. Microbiol. Biotechnol., 42(4):575–580 (1994) |
| X75504 | aceA: thiX | Partial Isocitrate lyase; ? | Reinscheid, D. J. et al. "Characterization of the isocitrate lyase gene from *Corynebacterium glutamicum* and biochemical analysis of the enzyme," J. Bacteriol., 176(12):3474–3483 (1994) |
| X76875 | | ATPase beta-subunit | Ludwig, W. et al. "Phylogenetic relationships of bacteria based on comparative sequence analysis of elongation factor Tu and ATP-synthase beta-subunit genes," Antonie Van Leeuwenhoek, 64:285–305 (1993) |
| X77034 | tuf | Elongation factor Tu | Ludwig, W. et al. "Phylogenetic relationships of bacteria based on comparative sequence analysis of elongation factor Tu and ATP-synthase beta-subunit genes," Antonie Van Leeuwenhoek, 64:285–305 (1993) |
| X77384 | recA | | Billman-Jacobe, H. "Nucleotide sequence of a recA gene from *Corynebacterium glutamicum*," DNA Seq., 4(6):403–404 (1994) |
| X78491 | aceB | Malate synthase | Reinscheid, D. J. et al. "Malate synthase from *Corynebacterium glutamicum* pta-ack operon encoding phosphotransacetylase: sequence analysis," Microbiology, 140:3099–3108 (1994) |
| X80629 | 16S rDNA | 16S ribosomal RNA | Rainey, F. A. et al. "Phylogenetic analysis of the genera *Rhodococcus* and Norcardia and evidence for the evolutionary origin of the genus Norcardia from within the radiation of *Rhodococcus* 7species," Microbiol., 141:523–528 (1995) |
| X81191 | gluA; gluB; gluC; gluD | Glutamate uptake system | Kronemeyer, W. et at. "Structure of the gluABCD cluster encoding the glutamate uptake system of *Corynebacterium glutamicum*," J. Bacteriol., 177(5):1152–1158 (1995) |
| X81379 | dapE | Succinyldiaminopimelate desuccinylase | Wehrmann, A. et al. "Analysis of different DNA fragments of *Corynebacterium glutamicum* complementing dapE of *Escherichia coli*," Microbiology, 40:3349–56 (1994) |

-continued

| GenBank™ Accession No. | Gene Name | Gene Function | Reference |
|---|---|---|---|
| X82061 | 16S rDNA | 16S ribosomal RNA | Ruimy, R. et al. "Phylogeny of the genus Corynebacterium deduced from analyses of small-subunit ribosomal DNA sequences," Int. J. Syst. Bacteriol., 45(4):740–746 (1995) |
| X82928 | asd; lysC | Aspartate-semialdehyde dehydrogenase;? | Serebrijski, I. et al. "Multicopy suppression by asd gene and osmotic stress-dependent complementation by heterologous proA in proA mutants," J. Bacteriol., 177(24):7255–7260 (1995) |
| X82929 | proA | Gamma-glutamyl phosphate reductase | Serebrijski, I. et al. "Multicopy suppression by asd gene and osmotic stress-dependent complementation by heterologous proA in proA mutants," J. Bacteriol., 177(24):7255–7260 (1995) |
| X84257 | 16S rDNA | 16S ribosomal RNA | Pascual, C. et al. "Phylogenetic analysis of the genus *Corynebacterium* based on 16S rRNA gene sequences," Int. J. Syst. Bacteriol., 45(4):724–728 (1995) |
| X85965 | aroP; dapE | Aromatic amino acid permease; ? | Wehrmann, A. et al. "Functional analysis of sequences adjacent to dapE of *Corynebacterium glutamicum* proline reveals the presence of aroP, which encodes the aromatic amino acid transporter," J. Bacteriol., 177(20):5991–5993 (1995) |
| X86157 | argB; argC; argD; argF; argJ | Acetylglutamate kinase; N-acetyl-gamma glutamyl-phosphate reductase; acetylornithine aminotransferase; ornithine carbamoyltransferase; glutamate N-acetyltransferase | Sakanyan, V. et al. "Genes and enzymes of the acetyl cycle of arginine biosynthesis in *Corynebacterium glutamicum*: enzyme evolution in the early steps of the arginine pathway," Microbiology, 142:99–108 (1996) |
| X89084 | pta; ackA | Phosphate acetyltransferase; acetate kinase | Reinscheid, D. J. et al. "Cloning, sequence analysis, expression and inactivation of the *Corynebacterium glutamicum* pta-ack operon encoding phosphotransacetylase and acetate kinase," Microbiology, 145:503–513 (1999) |
| X89850 | attB | Attachment Site | Le Marrec, C. et al. "Genetic characterization of site-specific integration functions of phi AAU2 infecting "*Arthrobacter aureus* C70," J. Bacteriol., 178(7):1996–2004 (1996) |
| X90356 | | Promoter fragment F1 | Patek, M. et al. "Promoters from *Corynebacterium glutamicum*: cloning, molecular analysis and search for a consensus motif," Microbiology, 142:1297–1309 (1996) |
| X90357 | | Promoter fragment F2 | Patek, M. et al. "Promoters from *Corynebacterium glutamicum*: cloning molecular analysis and search for a consensus motif," Microbiology, 142:1297–1309 (1996) |
| X90358 | | Promoter fragment F10 | Patek, M. et al. "Promoters from *Corynebacterium glutamicum*: cloning, molecular analysis and search for a consensus motif," Microbiology, 142:1297–1309 (1996) |
| X90359 | | Promoter fragment F13 | Patek, M. et al. "Promoters from *Corynebacterium glutamicum*: cloning, molecular analysis and search for a consensus motif," Microbiology, 142:1297–1309 (1996) |
| X90360 | | Promoter fragment F22 | Patek, M. et al. "Promoters from *Corynebacterium glutamicum*: cloning, molecular analysis and search for a consensus motif," Microbiology, 142:1297–1309 (1996) |
| X90361 | | Promoter fragment F34 | Patek, M. et al. "Promoters from *Corynebacterium glutamicum*: cloning, molecular analysis and search for a consensus motif," Microbiology, 142:1297–1309 (1996) |
| X90362 | | Promoter fragment F37 | Patek, M. et al. "Promoters from *Corynebacterium glutamicum*: cloning, molecular analysis and search for a consensus motif," Microbiology, |
| X90363 | | Promoter fragment F45 | Patek, M. et al. "Promoters from *Corynebacterium glutamicum*: cloning, molecular analysis and search for a consensus motif," Microbiology, 142:1297–1309 (1996) |
| X90364 | | Promoter fragment F64 | Patek, M. et al. "Promoters from *Corynebacterium glutamicum*: cloning, molecular analysis and search for a consensus motif," Microbiology, 142:1297–1309 (1996) |
| X90365 | | Promoter fragment F75 | Patek, M. et al. "Promoters from *Corynebacterium glutamicum*: cloning, molecular analysis and search for a consensus motif," Microbiology, 142:1297–1309 (1996) |
| X90366 | | Promoter fragment PF101 | Patek, M. et al. "Promoters from *Corynebacterium glutamicum*: cloning, molecular analysis and search for a consensus motif," Microbiology, 142:1297–1309 (1996) |
| X90367 | | Promoter fragment PF104 | Patek, M. et al. "Promoters from *Corynebacterium glutamicum*: cloning, molecular analysis and search for a consensus motif," Microbiology, 142:1297–1309 (1996) |
| X90368 | | Promoter fragment PF109 | Patek, M. et al. "Promoters from *Corynebacterium glutamicum*: cloning, molecular analysis and search for a consensus motif," Microbiology, 142:1297–1309 (1996) |
| X93513 | amt | Ammonium transport system | Siewe, R. M. et al. "Functional and genetic characterization of the (methyl) ammonium uptake carrier of *Corynebacterium glutamicum*," J. Biol. Chem., 271(10):5398-5403 (1996) |
| X93514 | betP | Glycine betaine transport system | Peter, H. et al. "Isolation, characterization, and expression of the *Corynebacterium glutamicum* betP gene, encoding the transport system for the compatible solute glycine betaine," J. Bacteriol., 178(17):5229–4234 (1996) |
| X95649 | orf4 | | Patek, M. et al. "Identification and transcriptional analysis of the dapB-ORF2-dapA-ORF4 operon of *Corynebacterium glutamicum*, encoding two enzymes involved in L-lysine synthesis," Biotechnol. Lett., 19:1113–1117 (1997) |

-continued

| GenBank™ Accession No. | Gene Name | Gene Function | Reference |
|---|---|---|---|
| X96471 | lysE; lysG | Lysing exporter protein; Lysine export regulator protein | Vrljic, M. et al. "A new type of transporter with a new type of cellular function: L-lysine export from *Corynebacterium glutamicum*," Mol. Microbiol., 22(5):815–826 (1996) |
| X96580 | panB; panC; xylB | 3-methyl-2-oxobutanoate hydroxymethyltransferase; pantoate-beta-alanine ligase; xylulokinase | Sahm, H. et al. "D-pantothenate synthesis in *Corynebacterium glutamicum* and use of panBC and genes encoding L-valine synthesis for D-pantothenate overproduction," Appl. Environ. Microbiol., 65(5):1973–1979 (1999) |
| X96962 | | Insertion sequence IS1207 and transposase | |
| X99289 | | Elongation factor P | Ramos, A. et al. "Cloning, sequencing and expression of the gene encoding elongation factor P in the amino-acid producer *Brevibacterium lactofermentum* (*Corynebacterium glutamicum* ATCC 13869)," Gene, 198:217–222 (1997) |
| Y00140 | thrB | Homoserine kinase | Mateos, L. M. et al. "Nucleotide sequence of the homoserine kinase (thrB) gene of the *Brevibacterium lactofermentum*," Nucleic Acids Res., 15(9):3922 (1987) |
| Y00151 | ddh | Meso-diaminopimelate D-dehydrogenase (EC 1.4.1.16) | Ishino, S. et al. "Nucleotide sequence of the meso-diaminopimelate D-dehydrogenase gene from *Corynebacterium glutamicum*," Nucleic Acids Res., 15(9):3917 (1987) |
| Y00476 | thrA | Homoserine dehydrogenase | Mateos, L. M. et al. "Nucleotide sequence of the homoserine dehydrogenase (thrA) gene of the *Brevibacterium lactofermentum*," Nucleic Acids Res., 15(24):10598 (1987) |
| Y00546 | hom; thrB | Homoserine dehydrogenase; homoserine kinase | Peoples, O.P. et al. "Nucleotide sequence and fine structural analysis of the *Corynebacterium glutamicum* hom-thrB operon," Mol. Microbiol., 2(1):63–72 (1988) |
| Y08964 | murC; ftsQ/divD; ftsZ | UPD-N-acetylmuramate-alanine ligase; division initiation protein or cell division protein; cell division protein | Honrubia, M. P. et al. "Identification, characterization, and chromosomal organization of the ftsZ gene from *Brevibacterium lactofermentum*," Mol. Gen. Genet., 259(1):97–104 (1998) |
| Y09163 | putP | High affinity proline transport system | Peter, H. et al. "Isolation of the putP gene of *Corynebacterium glutamicumproline* and characterization of a low-affinity uptake system for compatible solutes," Arch. Microbiol., 168(2):143–151 (1997) |
| Y09548 | pyc | Pyruvate carboxylase | Peters-Wendisch, P. G. et al. "Pyruvate carboxylase from *Corynebacterium glutamicum*: characterization, expression and inactivation of the pyc gene," Microbiology, 144:915–927 (1998) |
| Y09578 | leuB | 3-isopropylmalate dehydrogenase | Patek, M. et al. "Analysis of the leuB gene from *Corynebacterium glutamicum*," Appl. Microbiol. Biotechnol., 50(1):42–47 (1998) |
| Y12472 | | Attachment site bacteriophage Phi-16 | Moreau, S. et al. "Site-specific integration of corynephage Phi-16: The construction of an integration vector," Microbiol., 145:539–548 (1999) |
| Y12537 | proP | Proline/ectoine uptake system protein | Peter, H. et al. "*Corynebacterium glutamicum* is equipped with four secondary carriers for compatible solutes: Identification, sequencing, and characterization of the proline/ectoine uptake system, ProP, and the ectoine/prolinelglycine betaine carrier, EctP," J. Bacteriol., 180(22):6005–6012 (1998) |
| Y13221 | glnA | Glutamine synthetase I | Jakoby, M. et al. "Isolation of *Corynebacterium glutamicum* glnA gene encoding glutamine synthetase I," FEMS Microbiol. Lett., 154(1):81–88 (1997) |
| Y16642 | lpd | Dihydrolipoamide dehydrogenase | |
| Y18059 | | Attachment site Corynephage 304L | Moreau, S. et al. "Analysis of the integration functions of φ 304L: An integrase module among corynephages," Virology, 255(1):150–159 (1999) |
| Z21501 | argS; lysA | Arginyl-tRNA synthetase; diaminopimelate decarboxylase (partial) | Oguiza, J. A. et al. "A gene encoding arginyl-tRNA synthetase is located in the upstream region of the lysA gene in *Brevibacterium lactofermentum*: Regulation of argS-lysA cluster expression by arginine," J. Bacteriol., 175(22):7356–7362 (1993) |
| Z21502 | dapA; dapB | Dihydrodipicolinate synthase; dihydrodipicolinate reductase | Pisabarro, A. et al. "A cluster of three genes (dapA, orf2, and dapB) of *Brevibacterium lactofermentum* encodes dihydrodipicolinate reductase, and a third polypeptide of unknown function," J. Bacteriol., 175(9):2743–2749 (1993) |
| Z29563 | thrC | Threonine synthase | Malumbres, M. et al. "Analysis and expression of the thrC gene of the encoded threonine synthase," Appl. Enviran. Microbiol., 60(7)2209–2219 (1994) |
| Z46753 | 16S rDNA | Gene for 16S ribosomal RNA | |
| Z49822 | sigA | SigA sigma factor | Oguiza, J. A. et al "Multiple sigma factor genes in *Brevibacterium lactofermentum*: Characterization of sigA and sigB," J. Bacteriol., 178(2):550–553 (1996) |
| Z49823 | galE; dtxR | Catalytic activity UDP-galactose 4-epimerase; diphtheria toxin regulatory protein | Oguiza, J. A. et al "The galE gene encoding the UDP-galactose 4-epimerase of *Brevibacterium lactofermentum* is coupled transcriptionally to the dmdR gene," Gene, 177:103–107 (1996) |
| Z49824 | orf1; sigB | ?; SigB sigma factor | Oguiza, J. A. et al "Multiple sigma factor genes in *Brevibacterium lactofermentum*: Characterization of sigA and sigB," J. Bacteriol., 178(2):550–553 (1996) |
| Z66534 | | Transposase | Correia, A. et al. "Cloning and characterization of an IS-like element present in the genome of *Brevibacterium lactofermentum* ATCC 13869," Gene, 170(1):91–94 (1996) |

[i] A sequence for this gene was published in the indicated reference. However, the sequence obtained by the inventors of the present application is significantly longer than the published version. It is believed that the published version relied on an incorrect start codon, and thus represents only a fragment of the actual coding region.

TABLE 3

Corynebacterium and Brevibacterium Strains Which May be Used in the Pracitce of the Invention

| Genus | species | ATCC | FERM | NRRL | CECT | NCIMB | CBS | NCTC | DSMZ |
|---|---|---|---|---|---|---|---|---|---|
| Brevibacterium | ammoniagenes | 21054 | | | | | | | |
| Brevibactertum | ammoniagenes | 19350 | | | | | | | |
| Brevibacterium | ammoniagenes | 19351 | | | | | | | |
| Brevibacterium | ammoniagenes | 19352 | | | | | | | |
| Brevibacterium | ammoniagenes | 19353 | | | | | | | |
| Brevibacterium | ammoniagenes | 19354 | | | | | | | |
| Brevibacterium | ammoniagenes | 19355 | | | | | | | |
| Brevibacterium | ammoniagcnes | 19356 | | | | | | | |
| Brevibacterium | ammoniagenes | 21055 | | | | | | | |
| Brevibacterium | ammoniagcnes | 21077 | | | | | | | |
| Brevibacterium | ammoniagenes | 21553 | | | | | | | |
| Brevibacterium | ammoniagenes | 21580 | | | | | | | |
| Brevibacterium | ammoniagenes | 39101 | | | | | | | |
| Brevibacterium | butanicum | 21196 | | | | | | | |
| Brevibacterium | divaricatum | 21792 | P928 | | | | | | |
| Brevibacterium | flavum | 21474 | | | | | | | |
| Brevibacterium | flavum | 21129 | | | | | | | |
| Brevibacterium | flavum | 21518 | | | | | | | |
| Brevibacterium | flavum | | | B11474 | | | | | |
| Brevibacterium | flavum | | | B11472 | | | | | |
| Brevibacterium | flavum | 21127 | | | | | | | |
| Brevibacterium | flavum | 21128 | | | | | | | |
| Brevibacterium | flavum | 21427 | | | | | | | |
| Brevibacterium | flavum | 21475 | | | | | | | |
| Brevibacterium | flavum | 21517 | | | | | | | |
| Brevibacterium | flavum | 21528 | | | | | | | |
| Brevibacterium | flavum | 21529 | | | | | | | |
| Brevibacterium | flavum | | | B11477 | | | | | |
| Brevibacterium | flavum | | | B11478 | | | | | |
| Brevibacterium | flavum | 21127 | | | | | | | |
| Brevibacterium | flavum | | | B11474 | | | | | |
| Brevibacterium | healii | 15527 | | | | | | | |
| Brevibacterium | ketoglutamicum | 21004 | | | | | | | |
| Brevibacterium | ketoglutamicum | 21089 | | | | | | | |
| Brevibacterium | ketosoreductum | 21914 | | | | | | | |
| Brevibacterium | lactofermentum | | | | 70 | | | | |
| Brevibacterium | lactofermentum | | | | 74 | | | | |
| Brevibacterium | lactofermentum | | | | 77 | | | | |
| Brevibacterium | lactofermentum | 21798 | | | | | | | |
| Brevibacterium | lactofermentum | 21799 | | | | | | | |
| Brevibacterium | lactofermentum | 21800 | | | | | | | |
| Brevibacterium | lactofermentum | 21801 | | | | | | | |
| Brevibacterium | lactofermentum | | | B11470 | | | | | |
| Brevibacterium | lactofermentum | | | B11471 | | | | | |
| Brevibacterium | lactofermentum | 21086 | | | | | | | |
| Brevibacterium | lactofermentum | 21420 | | | | | | | |
| Brevibacterium | lactofermentum | 21086 | | | | | | | |
| Brevibacterium | lactofermentum | 31269 | | | | | | | |
| Brevibacterium | linens | 9174 | | | | | | | |
| Brevibacterium | linens | 19391 | | | | | | | |
| Brevibacterium | linens | 8377 | | | | | | | |
| Brevibacterium | paraffinolyticum | | | | | 11160 | | | |
| Brevibactcrium | spec. | | | | | | 717.73 | | |
| Brevibacterium | spec. | | | | | | 717.73 | | |
| Brevibacterium | spec. | 14604 | | | | | | | |
| Brevibacterium | spec. | 21860 | | | | | | | |
| Brevibacterium | spec. | 21864 | | | | | | | |
| Brevibacterium | spec. | 21865 | | | | | | | |
| Brevibacterium | spec. | 21866 | | | | | | | |
| Brevibacterium | spec. | 19240 | | | | | | | |
| Corynebacterium | acetoacidophilum | 21476 | | | | | | | |
| Corynebacterium | acetoacidophilum | 13870 | | | | | | | |
| Corynebacterium | acetoglutamicum | | | B11473 | | | | | |
| Corynebacterium | acetoglutamicum | | | B11475 | | | | | |
| Corynebacterium | acetoglutamicum | 15806 | | | | | | | |
| Corynebacterium | acetoglutamicum | 21491 | | | | | | | |
| Corynebacterium | acetoglutamicum | 31270 | | | | | | | |
| Corynebacterium | acetophilum | | | B3671 | | | | | |

TABLE 3-continued

Corynebacterium and Brevibacterium Strains Which May be Used in the Pracitce of the Invention

| Genus | species | ATCC | FERM | NRRL | CECT | NCIMB | CBS | NCTC | DSMZ |
|---|---|---|---|---|---|---|---|---|---|
| Corynebacterium | ammoniagenes | 6872 | | | | | | 2399 | |
| Corynebacterium | ammoniagenes | 15511 | | | | | | | |
| Corynebacterium | fujiokense | 21496 | | | | | | | |
| Corynebacterium | glutamicum | 14067 | | | | | | | |
| Corynebacterium | glutamicum | 39137 | | | | | | | |
| Corynebacterium | glutamicum | 21254 | | | | | | | |
| Corynebacterium | glutamicum | 21255 | | | | | | | |
| Corynebacterium | glutamicum | 31830 | | | | | | | |
| Corynebacterium | glutamicum | 13032 | | | | | | | |
| Corynebacterium | glutamicum | 14305 | | | | | | | |
| Corynebacterium | glutamicum | 15455 | | | | | | | |
| Corynebacterium | glutamicum | 13058 | | | | | | | |
| Corynebacterium | glutamicum | 13059 | | | | | | | |
| Corynebacterium | glutamicum | 13060 | | | | | | | |
| Corynebacterium | glutamicum | 21492 | | | | | | | |
| Corynebacterium | glutamicum | 21513 | | | | | | | |
| Corynebacterium | glutamicum | 21526 | | | | | | | |
| Corynebacterium | glutamicum | 21543 | | | | | | | |
| Corynebacterium | glutamicum | 13287 | | | | | | | |
| Corynebacterium | glutamicum | 21851 | | | | | | | |
| Corynebacterium | glutamicum | 21253 | | | | | | | |
| Corynebacterium | glutamicum | 21514 | | | | | | | |
| Corynebacterium | glutamicum | 21516 | | | | | | | |
| Corynebacterium | glutamicum | 21299 | | | | | | | |
| Corynebacterium | glutamicum | 21300 | | | | | | | |
| Corynebacterium | glutamicum | 39684 | | | | | | | |
| Corynebacterium | glutamicum | 21488 | | | | | | | |
| Corynebacterium | glutamicum | 21649 | | | | | | | |
| Corynebacterium | glutamicum | 21650 | | | | | | | |
| Corynebacterium | glutamicum | 19223 | | | | | | | |
| Corynebacterium | glutamicum | 13869 | | | | | | | |
| Corynebacterium | glutamicum | 21157 | | | | | | | |
| Corynebacterium | glutamicum | 21158 | | | | | | | |
| Corynebacterium | glutamicum | 21159 | | | | | | | |
| Corynebacterium | glutamicum | 21355 | | | | | | | |
| Corynebacterium | glutamicum | 31808 | | | | | | | |
| Corynebacterium | glutamicum | 21674 | | | | | | | |
| Corynebacterium | glutamicum | 21562 | | | | | | | |
| Corynebacterium | glutamicum | 21563 | | | | | | | |
| Corynebacterium | glutamicum | 21564 | | | | | | | |
| Corynebacterium | glutamicum | 21565 | | | | | | | |
| Corynebacterium | glutamicum | 21566 | | | | | | | |
| Corynebacterium | glutamicum | 21567 | | | | | | | |
| Corynebacterium | glutamicum | 21568 | | | | | | | |
| Corynebacterium | glutamicum | 21569 | | | | | | | |
| Corynebacterium | glutamicum | 21570 | | | | | | | |
| Corynebacterium | glutamicum | 21571 | | | | | | | |
| Corynebacterium | glutamicum | 21572 | | | | | | | |
| Corynebacterium | glutamicum | 21573 | | | | | | | |
| Corynebacterium | glutamicum | 21579 | | | | | | | |
| Corynebacterium | glutamicum | 19049 | | | | | | | |
| Corynebacterium | glutamicum | 19050 | | | | | | | |
| Corynebacterium | glutamicum | 19051 | | | | | | | |
| Corynebacterium | glutamicum | 19052 | | | | | | | |
| Corynebacterium | glutamicum | 19053 | | | | | | | |
| Corynebacterium | glutamicum | 19054 | | | | | | | |
| Corynebacterium | glutamicum | 19055 | | | | | | | |
| Corynebacterium | glutamicum | 19056 | | | | | | | |
| Corynebacterium | glutamicum | 19057 | | | | | | | |
| Corynebacterium | glutamicum | 19058 | | | | | | | |
| Corynebacterium | glutamicum | 19059 | | | | | | | |
| Corynebacterium | glutamicum | 19060 | | | | | | | |
| Corynebacterium | glutamicum | 19185 | | | | | | | |
| Corynebacterium | glutamicum | 13286 | | | | | | | |
| Corynebacterium | glutamicum | 21515 | | | | | | | |
| Corynebacterium | glutamicum | 21527 | | | | | | | |

TABLE 3-continued

Corynebacterium and Brevibacterium Strains Which May be Used in the Pracitce of the Invention

| Genus | species | ATCC | FERM | NRRL | CECT | NCIMB | CBS | NCTC | DSMZ |
|---|---|---|---|---|---|---|---|---|---|
| *Corynebacterium* | *glutamicum* | 21544 | | | | | | | |
| *Corynebacterium* | *glutamicum* | 21492 | | | | | | | |
| *Corynebacterium* | *glutamicum* | | | B8183 | | | | | |
| *Corynebacterium* | *glutamicum* | | | B8182 | | | | | |
| *Corynebacterium* | *glutamicum* | | | B12416 | | | | | |
| *Corynebacterium* | *glutamicum* | | | B12417 | | | | | |
| *Corynebacterium* | *glutamicum* | | | B12418 | | | | | |
| *Corynebacterium* | *glutamicum* | | | B11476 | | | | | |
| *Corynebacterium* | *glutamicum* | 21608 | | | | | | | |
| *Coryncbacterium* | *lilium* | | P973 | | | | | | |
| *Corynebacterium* | *nitrilophilus* | 21419 | | | | 11594 | | | |
| *Corynebacterium* | spec. | | P4445 | | | | | | |
| *Coryncbacterium* | spec. | | P4446 | | | | | | |
| *Corynebacterium* | spec. | 31088 | | | | | | | |
| *Corynebacterium* | spec. | 31089 | | | | | | | |
| *Corynebacterium* | spec. | 31090 | | | | | | | |
| *Corynebacterium* | spec. | 31090 | | | | | | | |
| *Corynebacterium* | spec. | 31090 | | | | | | | |
| *Corynebacterium* | spec. | 15954 | | | | | | | 20145 |
| *Corynebacterium* | spec. | 21857 | | | | | | | |
| *Corynebacterium* | spec. | 21862 | | | | | | | |
| *Corynebacterium* | spec. | 21863 | | | | | | | |

ATCC: American Type Culture Collection, Rockville, MD, USA
FERM: Fermentation Research Institute, Chiba, Japan
NRRL: ARS Culture Collection, Northern Regional Research Laboratory, Peoria, IL, USA
CECT: Coleccion Espanola de Cultivos Tipo, Valencia, Spain
NCIMB: National Collection of Industrial and Marine Bacteria Ltd., Aberdeen, UK
CBS: Centraalbureau voor Schimmelcultures, Baarn, NL
NCTC: National Collection of Type Cultures, London, UK
DSMZ: Deutsche Sammlung von Mikroorganismen und Zellkulturen, Braunschweig, Germany
For reference see Sugawara, H. et al. (1993) World directory of collections of cultures of microorganisms: Bacteria, fungi and yeasts (4$^{th}$ edn), World federation for culture collections world data center on microorganisms, Saimata, Japen.

TABLE 4

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00062 | 1521 | GB_HTG2:AC007366 | 185001 | AC007366 | *Homo sapiens* clone NH0501G22, *** SEQUENCING IN PROGRESS ***, 3 unordered pieces. | *Homo sapiens* | 39,080 | Jun. 5, 1999 |
| rxa00084 | 948 | GB_PR3:HSU80741 | 912 | U80741 | *Homo sapiens* CAGH44 mRNA, partial cds. | *Homo sapiens* | 39,264 | Dec. 18, 1997 |
| | | GB_PL1:BNDNAIRNA | 1732 | X89901 | *B. nigra* DNA for tRNA like gene. | *Brassica nigra* | 36,725 | Feb. 6, 1997 |
| | | GB_PR3:HSU80741 | 912 | U80741 | *Homo sapiens* CAGH44 mRNA, partial cds. | *Homo sapiens* | 38,957 | Dec. 18, 1997 |
| rxa00109 | 735 | GB_GSS9:AQ163721 | 388 | AQ163721 | HS_2245_A1_F07_MF CIT Approved Human Genomic Sperm Library D *Homo sapiens* genomic clone Plate = 2245 Col = 13 Row = K, genomic survey sequence. | *Homo sapiens* | 45,066 | Oct. 16, 1998 |
| | | GB_HTG4:AC007054 | 171979 | AC007054 | *Drosophila melanogaster* chromosome 2 clone BACR45O18 (D527) RPCI-98 45.O.18 map 41E-41E strain y; cn bw sp. **SEQUENCING IN PROGRESS**, 13 unordered pieces. | *Drosophila melanogaster* | 36,589 | Oct. 13, 1999 |
| | | GB_HTG4:AC007054 | 171979 | AC007054 | *Drosophila melanogaster* chromosome 2 clone BACR45O18 (D527) RPCI-98 45.O.18 map 41E-41E strain y; cn bw sp. **SEQUENCING IN PROGRESS**, 13 unordered pieces. | *Drosophila melanogaster* | 36,589 | Oct. 13, 1999 |
| rxa00215 | 1449 | GB_BA1:SC9C7 | 31360 | AL035161 | *Streptomyces coelicolor* cosmid 9C7. | *Streptomyces coelicolor* | 44,444 | Jan. 12, 1999 |
| | | GB_BA1:SCE94 | 38532 | AL049628 | *Streptomyces coelicolor* cosmid E94. | *Streptomyces coelicolor* | 46,313 | April 12, 1999 |
| | | GB_BA2:AF110185 | 20302 | AF110185 | *Burkholderia pseudomallei* strain 1026b DbhB (dbhB), general secretory pathway protein D (gspD), general secretory pathway protein E (gspE), general secretory pathway protein F (gspF), GspC (gspC), general secretory pathway protein G (gspG), general secretory pathway protein H (gspH), general secretory pathway protein I (gspI), general secretory pathway protein J (gspJ), general secretory pathway protein K (gspK), general secretory pathway protein L (gspL), general secretory pathway protein M (gspM), and general secretory pathway protein N (gspN) genes, complete cds; and unknown genes. | *Burkholderia pseudomallei* | 44,159 | Aug. 2, 1999 |
| rxa00289 | 1299 | GB_EST6:N80167 | 384 | N80167 | za65g02.s1 Soares fetal liver spleen 1NFLS *Homo sapiens* cDNA clone IMAGE:297458 3', mRNA sequence. | *Homo sapiens* | 40,420 | Mar. 29, 1996 |
| | | GB_STS:G37084 | 384 | G37084 | SHGC-56832 Human *Homo sapiens* STS genomic, sequence tagged site. | *Homo sapiens* | 40,420 | Mar. 30, 1998 |
| | | GB_STS:G37084 | 384 | G37084 | SHGC-56832 Human *Homo sapiens* STS genomic, sequence tagged site. | *Homo sapiens* | 40,420 | Mar. 30, 1998 |
| rxa00404 | 2439 | GB_BA1:MTCY22D7 | 31859 | Z83866 | *Mycobacterium tuberculosis* H37Rv complete genome; segment 133/162. | *Mycobacterium tuberculosis* | 60,271 | Jun. 17, 1998 |
| | | GB_BA1:ECU82598 | 136742 | U82598 | *Escherichia coli* genomic sequence of minutes 9 to 12. | *Escherichia coli* | 54,256 | Jan. 15, 1997 |
| | | GB_BA2:AE000165 | 12003 | AE000165 | *Escherichia coli* K-12 MG1655 section 55 of 400 of the complete genome. | *Escherichia coli* | 54,256 | Nov. 12, 1998 |
| rxa00479 | 2313 | GB_BA1:SCF43A | 35437 | AL096837 | *Streptomyces coelicolor* cosmid F43A. | *Streptomyces coelicolor* A3(2) | 36,245 | Jul. 13, 1999 |
| | | GB_GSS2:CNS015U4 | 1036 | AL105910 | *Drosophila melanogaster* genome survey sequence SP6 end of BAC BACN14G08 of DrosBAC library from *Drosophila melanogaster* (fruit fly), genomic survey sequence. | *Drosophila melanogaster* | 37,573 | Jul. 26, 1999 |
| rxa00497 | 420 | GB_PR3:HSA494O16 | 50502 | AL117328 | Human DNA sequence from clone 494O16 on chromosome 22, complete sequence. | *Homo sapiens* | 36,475 | Nov. 23, 1999 |
| | | GB_BA1:MTCY78 | 33818 | Z77165 | *Mycobacterium tuberculosis* H37Rv complete genome; segment 145/162. | *Mycobacterium tuberculosis* | 40,250 | Jun. 17, 1998 |
| | | GB_BA2:AF079544 | 817 | AF079544 | *Mycobacterium avium* GroESL operon, partial sequence. | *Mycobacterium avium* | 64,439 | Aug. 16, 1998 |
| | | GB_BA6A1:MTGROEOP | 2987 | X60350 | *M. tuberculosis* groE gene for KCS and 10-kDa products. | *Mycobacterium tuberculosis* | 62,857 | Apr. 23, 1992 |
| rxa00575 | | | | | | | | |
| rxa00599 | 510 | GB_GBSS10:AQ199703 | 439 | AQ199703 | RPCI11-46O13.TJ RPCI-11 *Homo sapiens* genomic clone RPCI-11-46O13, genomic survey sequence. | *Homo sapiens* | 42,657 | Apr. 20, 1999 |
| | | GB_PR2:AC002127 | 144165 | AC002127 | Human BAC done RG305H12 from 7q21, complete sequence. | *Homo sapiens* | 37,052 | May 27, 1997 |
| | | GB_STS:G51234 | 439 | G51234 | SHGC-80708 Human *Homo sapiens* STS genomic, sequence tagged site. | *Homo sapiens* | 42,657 | Jun. 25, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00600 | 1221 | GB_BA1:MTCY441 | 35187 | Z80225 | *Mycobacterium tuberculosis* H37Rv complete genome; segment 118/162. | *Mycobacterium tuberculosis* | 56,183 | Jun. 18, 1998 |
| | | GB_BA1:MSGY223 | 42061 | AD000019 | *Mycobacterium tuberculosis* sequence from clone y223. | *Mycobacterium tuberculosis* | 37,217 | Dec. 10, 1996 |
| | | GB_BA1:BSUB0014 | 213420 | Z99117 | *Bacillus subtilis* complete genome (section 14 of 21): from 2599451 to 2812870. | *Bacillus subtilis* | 36,553 | Nov. 26, 1997 |
| rxa00605 | 1603 | GB_BA2:AF069070 | 2776 | AF069070 | Endosymbiont of *Onchocerca volvulus* catalase gene, complete cds. | endosymbiont of *Onocnocerca volvulus* | 55,396 | Nov. 25, 1998 |
| | | GB_BA1:OVCAT | 1845 | X82176 | *Onchocerca volvulus* endobacterial mRNA for catalase. | endosymbiont of *Onchocerca volvulus* | 55,396 | Nov. 26, 1998 |
| rxa00648 | 1533 | GB_BA1:SC2G5 | 38404 | AL033478 | *Streptomyces coelicolor* cosmid 2G5. | *Streptomyces coelicolor* | 39,530 | Jun. 11, 1999 |
| | | GB_HTG1:HS74O16 | 169401 | AL110119 | *Homo sapiens* chromosome 21 clone RPCIP704O1674 map 21q21, *** SEQUENCING IN PROGRESS ***, in unordered pieces. | *Homo sapiens* | 36,327 | Aug. 27, 1999 |
| | | GB_HTG1:HS74O16 | 169401 | AL110119 | *Homo sapiens* chromosome 21 clone RPCIP704O1674 map 21q21, *** SEQUENCING IN PROGRESS ***, in unordered pieces. | *Homo sapiens* | 36,327 | Aug. 27, 1999 |
| | | GB_HTG1:HS74O16 | 169401 | AL110119 | *Homo sapiens* chromosome 21 clone RPCIP7C4O1674 map 21q21, *** SEQUENCING IN PROGRESS ***, in unordered pieces. | *Homo sapiens* | 35,119 | Aug. 27, 1999 |
| rxa00764 | 1239 | GB_EST36:AI898007 | 609 | AI898007 | EST267450 tomato ovary, TAMU *Lycopersicon esculentum* cDNA clone cLED31K22, mRNA sequence. | *Lycopersicon esculentum* | 34,323 | Jul. 27, 1999 |
| | | GB_BA2:PAU93274 | 8008 | U93274 | *Pseudomonas aeruginosa* YafE (yafE), LeuB (leuB), Asd (asd), FimV (fimV), and HisT (hisT) genes, complete cds; TrpF (trpF) gene, partial cds; and unknown gene. | *Pseudomonas aeruginosa* | 35,895 | Jun. 23, 1998 |
| | | GB_BA2:PAU93274 | 8008 | U93274 | *Pseudomonas aeruginosa* YafE (yafE), LeuB (leuB), Asd (asd), FimV (fimV), and HisT (hisT) genes, complete cds; TrpF (trpF) gene, partial cds; and unknown gene. | *Pseudomonas aeruginosa* | 41,417 | Jun. 23, 1998 |
| rxa00803 | 1353 | GB_IN2:CELH34C03 | 27748 | AF100662 | *Caenorhabditis elegans* cosmid H34C03. | *Caenorhabditis elegans* | 34,152 | Oct. 28, 1998 |
| | | GB_HTG2:AC007905 | 100722 | AC007905 | *Homo sapiens* chromosome 16q24.3 clone PAC 754F23, *** SEQUENCING IN PROGRESS ***, 33 unordered pieces. | *Homo sapiens* | 37,472 | Jun. 24, 1999 |
| | | GB_HTG2:AC007905 | 100722 | AC007905 | *Homo sapiens* chromosome 16q24.3 clone PAC 754F23, *** SEQUENCING IN PROGRESS ***, 33 unordered pieces. | *Homo sapiens* | 37,472 | Jun. 24, 1999 |
| rxa00810 | 324 | GB_BA1:MTY15C10 | 33050 | Z95436 | *Mycobacterium tuberculosis* H37Rv complete genome; segment 154/162. | *Mycobacterium tuberculosis* | 34,615 | Jun. 17, 1998 |
| | | GB_BA1:MLCB2548 | 38916 | AL023093 | *Mycobactertum leprae* cosmid B2548. | *Mycobacterium leprae* | 34,615 | Aug. 27, 1999 |
| | | GB_BA1:ECOUW76 | 225419 | U00039 | *E. coli* chromosomal region from 76.0 to 81.5 minutes. | *Escherichia coli* | 52,997 | Nov. 7, 1996 |
| rxa00829 | 2463 | GB_BA1:SCSC7 | 41906 | AL031515 | *Streptomyces coelicolor* cosmid 5C7. | *Streptomyces coelicolor* | 65,269 | Sep. 7, 1998 |
| | | GB_BA1:SC5F2A | 40105 | AL049587 | *Streptomyces coelicolor* cosmid 5F2A. | *Streptomyces coelicolor* | 37,490 | May. 24, 1999 |
| | | GB_BA1:STMDRRC | 3374 | L76359 | *Streptomyces peucetius* daunorubicin resistance protein (drrC) gene, complete cds. | *Streptomyces peucetius* | 55,279 | Dec. 24, 1996 |
| rxa00843 | 468 | GB_BA1:MTCY9C4 | 15916 | Z77250 | *Mycobacterium tuberculosis* H37Rv complete genome; segment 113/162. | *Mycobacterium tuberculosis* | 40,000 | Jun. 17, 1998 |
| | | GB_BA1:MTCY9C4 | 15916 | Z77250 | *Mycobacterium tuberculosis* H37Rv complete genome; segment 113/162. | *Mycobacterium tuberculosis* | 37,773 | Jun. 17, 1998 |
| rxa00858 | 568 | GB_BA1:SCC54 | 30753 | AL035591 | *Streptomyces coelicolor* cosmid C54. | *Streptomyces coelicolor* | 39,602 | Jun. 11, 1999 |
| | | GB_EST18:N95610 | 547 | N96610 | 21285 Lambda-PRL1 *Arabidopsis thaliana* cDNA clone F10G3T7, mRNA sequence. | *Arabidopsis thaliana* | 37,801 | Jan. 5, 1998 |
| | | GB_EST18:T45493 | 436 | T45493 | 8756 Lambda-PRL2 *Arabidopsis thaliana* cDNA clone 133C14T7, mRNA sequence. | *Arabidopsis thaliana* | 34,194 | Aug. 4, 1998 |
| rxa00886 | 1269 | GB_BA1:SYCSL11H | 132106 | D64006 | *Synechocystis* sp. PCC6803 complete genome, 25/27, 3138604-3270709. | *Synechocystis sp.* | 37,459 | Feb. 13, 1999 |
| | | GB_BA1:SCDNAJ | 5611 | X77458 | *S. coelicolor* dnaK, grpE and dnaJ genes. | *Streptomyces coelicolor* | 49,744 | Nov. 21, 1996 |
| | | GB_BA1:STMDNAK | 4648 | L46700 | *Steptomyces coelicolor* (strain A3(2)) dnaK operon encoding molecular chaperones (dnaK, knaJ), grpE and hspR genes, complete cds's. | *Streptomyces coelicolor* | 49,583 | Nov. 22, 1996 |
| rxa00900 | 975 | GB_BA2:ECOUW67_0 | 110000 | U18997 | *Escherichia coli* K-12 chromosomal region from 67.4 to 76.0 minutes. | *Escherichia coli* | 38,314 | U18997 |
| | | GB_BA2:ECOUW67_0 | 110000 | U18997 | *Escherichia coli* K-12 chromosomal region from 67.4 to 76.0 minutes. | *Escherichia coli* | 38,314 | U18997 |
| | | GB_BA2:AE000393 | 10516 | AE000393 | *Escherichia coli* K-12 MG1655 section 283 of 400 of the complete genome. | *Escherichia coli* | 38,314 | Nov. 12, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00901 | 537 | GB_HTG3:AC010757 | 175571 | AC010757 | *Homo sapiens* chromosome 18 clone 128_C_18 map 18, *** SEQUENCING IN PROGRESS ***, 20 unordered pieces. | *Homo sapiens* | 34,857 | Sep. 22, 1999 |
| | | GB_HTG3:AC010757 | 175571 | AC010757 | *Homo sapiens* chromosome 18 clone 128_C_18 map 18, *** SEQUENCING IN PROGRESS ***, 20 unordered pieces. | *Homo sapiens* | 34,857 | Sep. 22, 1999 |
| | | GB_HTG3:AC011283 | 87295 | AC011283 | *Homo sapiens* clone MS2016A09, *** SEQUENCING IN PROGRESS ***, 1 unordered pieces. | *Homo sapiens* | 35,448 | Oct. 7, 1999 |
| rxa00981 | 753 | GB_OV:GGA245664 | 512 | AJ245664 | *Gallus gallus* partial mRNA for ATP-citrate lyase (ACL gene). | *Gallus gallus* | 37,538 | Sep. 28, 1999 |
| | | GB_PL2:AC007887 | 159434 | AC007887 | Genomic sequence for *Arabidopsis thaliana* BAC F15O4 from chromosome I, complete sequence. | *Arabidopsis thaliana* | 37,600 | Oct. 4, 1999 |
| | | GB_GSS1:CNS00RNW | 542 | AL087338 | *Arabidopsis thaliana* genome survey sequence T7 end of BAC F14D7 of IGF library from strain columbia of *Arabidopsis thaliana*, genomic survey sequence. | *Arabidopsis thaliana* | 41,264 | Jun. 28, 1999 |
| rxa00995 | 854 | GB_EST29:AI553951 | 450 | AI553951 | tc54d01.x1 Soares_NFL_T_GBC_S1 *Homo sapiens* cDNA clone IMAGE:2090497 3' similar to gb:X02067 *H. sapiens* mRNA for 7SL RNA pseudogene (HUMAN);, mRNA sequence. | *Homo sapiens* | 42,627 | Apr. 13, 1999 |
| | | GB_PR3:AC003029 | 139166 | AC003029 | *Homo sapiens* Chromosome 12q24 PAC RPCI3-462E2 (Roswell Park Cancer Institute Human PAC library) complete sequence. | *Homo sapiens* | 38,915 | Sep. 17, 1998 |
| rxa00996 | 864 | GB_BA1:EAY14603 | 4479 | Y14603 | *Erwinia amylovora* sriA, sriE, sriB, sriD, sriM and sriR genes. | *Erwinia amylovora* | 37,694 | Jan. 6, 1998 |
| | | GB_BA2:AF001001 | 10730 | AF001001 | *Archaeoglobus fulgidus* section 106 of 172 of the complete genome. | *Archaeoglobus fulgidus* | 41,078 | Dec. 15, 1997 |
| | | GB_EST30:AV018764 | 242 | AV018764 | AV018764 *Mus musculus* 18-day embryo C57BL/6J *Mus musculus* cDNA clone 1190006M16, mRNA sequence. | *Mus musculus* | 39,669 | Aug. 28, 1999 |
| rxa01010 | 1242 | GB_GSS3:B24189 | 377 | B24189 | F19E16TF IGF *Arabidopsis thaliana* genomic clone F19E16, genomic survey sequence. | *Arabidopsis thaliana* | 44,385 | Oct. 10, 1997 |
| | | GB_OV:AF007068 | 356 | AF007068 | *Coturnix coturnix* arylalkylamine N-acetyltransferase mRNA, partial cds. | *Coturnix coturnix* | 46,629 | Jul 12, 1997 |
| | | GB_EST10:AA166324 | 514 | AA166324 | ms50c09.ri Life Tech mouse embryo 13 5dpc 10666014 *Mus musculus* cDNA clone IMAGE:614992 5' similar to SW:NEST_RAT P21263 NESTIN.; mRNA sequence. | *Mus musculus* | 38,677 | Dec. 19, 1996 |
| | | GB_EST7:W89968 | 46 | W89968 | mf64g11.r1 Soares mouse embryo NbME13.5 14.5 *Mus musculus* cDNA clone IMAGE:419108 5' similar to SW:NEST_RAT P21263 NESTIN. [1]; mRNA sequence. | *Mus musculus* | 58,696 | Sep. 12, 1996 |
| rxa01051 | 732 | GB_GSS12:AQ381423 | 579 | AQ381423 | RPCI11-135F10.TJ RPCI-11 *Homo sapiens* genomic clone RPCI-11-135F10. genomic survey sequence. | *Homo sapiens* | 37,651 | May 21, 1999 |
| | | GB_HTG6:AC010901 | 206121 | AC10901 | *Homo sapiens* clone RP11-544J22, WORKING DRAFT SEQUENCE, 1 unordered pieces. | *Homo sapiens* | 36,011 | Dec. 4, 1999 |
| | | GB_GSS5:AQ746932 | 837 | AQ746932 | HS_5538_A1_A11_T7A RPCI-11 Human Male BAC Library *Homo sapiens* genomic clone Plate = 1114 Col = 21 Row = A, genomic survey sequence. | *Homo sapiens* | 38,640 | Jul. 19, 1999 |
| rxa01052 | 432 | GB_In1:CELC13D9 | 43487 | AF016420 | *Caenorhabditis elegans* cosmid C13D9. | *Caenorhabditis elegans* | 39,344 | Aug. 2, 1997 |
| | | GB_IN1:CELC13D9 | 43487 | AF016420 | *Caenorhabditis elegans* cosmid C13D9. | *Caenorhabditis elegans* | 38,780 | Aug. 2, 1997 |
| rxa01053 | 543 | GB_OV:CHKMAFG1 | 1316 | D28601 | Chicken novel maf-related gene mafG encoding bZip nuclear protein MafG, promoter region and exon 1. | *Gallus gallus* | 39,205 | Feb. 7, 1999 |
| | | GB_HTG6:AC010765 | 146468 | AC010765 | *Homo sapiens* clone RP11-115N6, *** SEQUENCING IN PROGRESS ***, 26 unordered pieces. | *Homo sapiens* | 32,961 | Dec. 7, 1999 |
| | | GB_HTGB:AC010765 | 146468 | AC010765 | *Homo sapiens* clone RP11-115N6, *** SEQUENCING IN PROGRESS ***, 26 unordered pieces. | *Homo sapiens* | 38,476 | Dec. 7, 1999 |
| rxa01054 | 612 | GB_PL1:PHNPNGLP | 962 | D45425 | *Pharbitis nil* mRNA for *Pharbitis nil* Germin-like protein precurser, complete cds. | *Ipomaea nil* | 42,925 | Feb. 10, 1999 |
| | | GB_HTG2:HSI402N21 | 170302 | AL049553 | *Homo sapiens* chromosome 6 clone RP3-402N21 map p21.1-21.31, ***SEQUENCING IN PROGRESS ***, in unordered pieces. | *Homo sapiens* | 36,825 | Dec. 3, 1999 |
| | | GB_HTG2:HSI402N21 | 170302 | AL049553 | *Homo sapiens* chromosome 6 clone RP3-402N21 map p21.1-21.31, ***SEQUENCING IN PROGRESS ***, in unordered pieces. | *Homo sapiens* | 36,825 | Dec. 3, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01217 | 723 | GB_IN2:CELF18A12 | 29784 | AF016688 | Caenorhabditis elegans cosmid F18A12. | Caenorhabditis elegans | 35,794 | Oct. 8, 1999 |
|  |  | GB_IN2:CELF18A12 | 29784 | AF016688 | Caenorhabditis elegans cosmid F18A12. | Caenorhabditis elegans | 40,625 | Oct. 8, 1999 |
|  |  | GB_RO:MUSMCFTR | 6304 | M60493 | Mouse cystic fibrosis transmembrane conductance regulator (CFTR) mRNA, complete cds. | Mus musculus | 37,793 | Jun. 10, 1994 |
| rxa01320 | 1770 | GB_BA2:AF031037 | 1472 | AF031037 | Neisseria meningitidis chloramphenicol acetyltransferase gene, complete cds. | Neisseria meningitidis | 35,014 | Apr. 21, 1998 |
|  |  | GB_HTG1:PFMAL13PA | 80518 | AL109815 | Plasmodium falciparum chromosome 13 strain 3D7, **** SEQUENCING IN PROGRESS ****, in unordered pieces. | Plasmodium falciparum | 17,697 | Aug. 19, 1999 |
|  |  | GB_HTG1:PFMAL13PA | 80518 | AL109815 | Plasmodium falciparum chromosome 13 strain 3D7, **** SEQUENCING IN PROGRESS ****, in unordered pieces. | Plasmodium falciparum | 17,697 | Aug. 19, 1999 |
| rxa01345 | 1575 | GB_PR3:AC005224 | 166687 | AC005224 | Homo sapiens chromosome 17, clone hRPK.214_O_1, complete sequence. | Homo sapiens | 38,195 | Aug. 14, 1998 |
|  |  | GB_PR3:AC005224 | 166687 | AC005224 | Homo sapiens chromosome 17, clone hRPK.214_O_1, complete sequence. | Homo sapiens | 38,611 | Aug. 14, 1998 |
|  |  | GB_HTG3:AC011500_1 | 300851 | AC011500 | Homo sapiens chromosome 19 clone CIT978SKB_60E11, *** SEQUENCING IN PROGRESS ***, 246 unordered pieces. | Homo sapiens | 36,446 | AC011500 |
| rxa01407 | 1014 | GB_HTG3:AC010831 | 70233 | AC010831 | Homo sapiens clone 6_1_24, LOW-PASS SEQUENCE SAMPLING. | Homo sapiens | 35,764 | Sep. 23, 1999 |
|  |  | GB_HTG3:AC010831 | 70233 | AC010831 | Homo sapiens clone 6_1_24, LOW-PASS SEQUENCE SAMPLING. | Homo sapiens | 35,764 | Sep. 23, 1999 |
|  |  | GB_PR3:AC004058 | 38400 | AC004058 | Homo sapiens chromosome 4 clone B241P19 map 4q25, complete sequence. | Homo sapiens | 40,778 | Sep. 30, 1998 |
| rxa01408 | 324 | GB_PR4:AF152365 | 246546 | AF152365 | Homo sapiens constitutive fragile region FRA3B sequence. | Homo sapiens | 41,234 | Aug. 1, 1999 |
|  |  | GB_HTG3:AC007890 | 121256 | AC007890 | Drosophila melanogaster chromosome 3 clone BACR02G21 (D722) RPCI-98 02.G.21 map 90E-91A strain y; cn bw sp, **** SEQUENCING IN PROGRESS ***, 89 unordered pieces. | Drosophila melanogaster | 39,432 | Sep. 3, 1999 |
|  |  | GB_HTG3:AC007890 | 121256 | AC007890 | Drosophila melanogaster chromosome 3 clone BACR02G21 (D722) RPCI-98 02.G.21 map 90E-91A strain y; cn bw sp, **** SEQUENCING IN PROGRESS***, 89 unordered pieces. | Drosophila melanogaster | 39,432 | Sep. 3, 1999 |
| rxa01524 | 1566 | GB_BA1:BSUB0015 | 218410 | Z99118 | Bacillus sibitilis complete genome (section 15 of 21): from 2795131 to 3013540. | Bacillus subtilis | 38,201 | Nov. 26, 1997 |
|  |  | GB_HTG2:AC008260 | 107439 | AC008260 | Drosophila melanogaster chromosome 2 clone BACR13J10 (D924) RPCI-98 13.J.10 map 47B-47C strain y; cn bw sp, **** SEQUENCING IN PROGRESS****, 82 unordered pieces. | Drosophila melanogaster | 38,302 | Aug. 2, 1999 |
|  |  | GB_HTG2:AC008260 | 107439 | AC008260 | Drosophila melanogaster chromosome 2 clone BACR13J10 (D924) RPCI-98 13.J.10 map 47B-47C strain y; cn bw sp, **** SEQUENCING IN PROGRESS ****, 82 unordered pieces. | Drosophila melanogaster | 38,302 | Aug. 2, 1999 |
| rxa01578 | 1510 | GB_PR4:AF111170 | 148083 | AF111170 | Homo sapiens 14q32 Jagged2 gene, complete cds; and unknown gene. | Homo sapiens | 37,873 | Jul 14, 1999 |
|  |  | GB_PR4:AF111170 | 148083 | AF111170 | Homo sapiens 14q32 Jagged2 gene, complete cds; and unknown gene. | Homo sapiens | 40,220 | Jul 14, 1999 |
|  |  | GB_BA1:AEY13732 | 6740 | Y13732 | Alcaligenes eutrophus genes for ureases, ureD1, ureD2, ureA, ureB, and ORF1, ORF2. | Ralstonia eutropha | 42,960 | Sep. 23, 1997 |
| rxa01616 | 1605 | GB_BA2:AF088857 | 2908 | AF088857 | Vogesella indigofera indigodine biosynthesis regulatory locus, complete sequence. | Vogesella indigofera | 37,626 | Sep. 10, 1998 |
|  |  | GB_IN1:CEM04D8 | 21552 | Z32682 | Caenorhabditis elegans cosmid M04D8, complete sequence. | Caenorhabditis elegans | 37,237 | Nov. 23, 1998 |
|  |  | GB_EST3:AI281910 | 276 | AI281910 | qt82d04.x1 NCI_CGAP_Co14 Homo sapiens cDNA clone IMAGE:1961767 3', mRNA sequence. | Homo sapiens | 36,406 | Dec. 21, 1998 |
| rxa01666 | 1500 | GB_BA1:CGU43535 | 2531 | U43535 | Corynebacterium glutamicum multidrug resistance protein (cmr) gene, complete cds. | Corynebacterium glutamicum | 99,933 | Apr. 9, 1997 |
|  |  | GB_HTG3:AC009213 | 114735 | AC009213 | Drosophila melanogaster chromosome 3 clone BACR09F18 (D812) RPCI-98 09.F.18 map 98D-98D strain y; cn bw sp, **** SEQUENCING IN PROGRESS ****, 109 unordered pieces. | Drosophila melanogaster | 36,111 | Aug. 23, 1999 |
|  |  | GB_HTG3:AC009213 | 114735 | AC009213 | Drosophila melanogaster chromosome 3 clone BACR09F18 (D812) RPCI-98 09.F.18 map 98D-98D strain y; cn bw sp, **** SEQUENCING IN PROGRESS ****, 109 unordered pieces. | Drosophila melanogaster | 36,111 | Aug. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01674 | 1017 | GB_PL1:AB017159 | 1859 | AB017159 | *Daucus carota* mRNA for citrate synthase, complete cds. | *Daucus carota* | 39,537 | May 1, 1999 |
| | | GB_PR1:HUMGNOS48 | 23142 | D26607 | *Homo sapiens* endothelial nitric oxide synthase gene, complete cds. | *Homo sapiens* | 36,419 | Jul. 13, 1999 |
| | | GB_HTG3:AC011234 | 154754 | AC011234 | *Homo sapiens* clone NH0166D23, *** SEQUENCING IN PROGRESS ***, 7 unordered pieces. | *Homo sapiens* | 36,317 | Oct. 4, 1999 |
| rxa01873 | 1359 | GB_HTG3:AC009450 | 124337 | AC009450 | *Homo sapiens* chromosome 9 clone 30_C_23 map 9, *** SEQUENCING IN PROGRESS ***, 20 unordered pieces. | *Homo sapiens* | 35,303 | Aug. 22, 1999 |
| | | GB_HTG3:AC009450 | 124337 | AC009450 | *Homo sapiens* chromosome 9 clone 30_C_23 map 9, *** SEQUENCING IN PROGRESS ***, 20 unordered pieces. | *Homo sapiens* | 35,303 | Aug. 22, 1999 |
| | | GB_HTG3:AC009919 | 134724 | AC009919 | *Homo sapiens* clone 115_I_23, LOW-PASS SEQUENCE SAMPLING. | *Homo sapiens* | 35,409 | Sep. 8, 1999 |
| rxa01922 | 1275 | GB_BA1:ECONEUC | 1676 | M84026 | *E. coli* protein p7 (neu C) gene, complete cds. | *Escherichia coli* | 35,189 | Apr. 26, 1993 |
| | | GB_HTG2:AC007853 | 116280 | AC007853 | *Drosophila melanogaster* chromosome 3 clone BACR03L02 (D766) RPCI-98 03.L.2 map 96B-96C strain y; cn bw sp, *** SEQUENCING IN PROGRESS ***, 80 unordered pieces. | *Drosophila melanogaster* | 34,365 | Aug. 2, 1999 |
| | | GB_HTG2:AC007853 | 116280 | AC007853 | *Drosophila melanogaster* chromosome 3 clone BACR03L02 (D766) RPCI-98 03.L.2 map 96B-96C strain y; cn bw sp, *** SEQUENCING IN PROGRESS ***, 80 unordered pieces. | *Drosophila melanogaster* | 34,365 | Aug. 2, 1999 |
| rxa01936 | 1395 | GB_HTGA:AC010037 | 166249 | AC010037 | *Drosophila melanogaster* chromosome 3L/66B6 clone RPCI98-6E4, *** SEQUENCING IN PROGRESS ***, 52 unordered pieces. | *Drosophila melanogaster* | 38,534 | Oct. 16, 1999 |
| | | GB_HTG4:AC010037 | 166249 | AC010037 | *Drosophila melanogaster* chromosome 3L/66B6 clone RPCI98-6E4, *** SEQUENCING IN PROGRESS ***, 52 unordered pieces. | *Drosophila melanogaster* | 38,534 | Oct. 16, 1999 |
| | | GB_PR4:AC005552 | 167228 | AC005552 | *Homo sapiens* chromosome 17, clone hRPK.212_E_8, complete sequence. | *Homo sapiens* | 36,249 | Nov. 26, 1996 |
| rxa01984 | 420 | GB_PR1:HS169C8F | 245 | Z57239 | *H. sapiens* CpG island DNA genomic Mse1 fragment, clone 169c8, forward read cpg169c8.ft1a. | *Homo sapiens* | 45,679 | Oct. 18, 1995 |
| | | GB_BA1:SERAITBXIS | 3255 | L11597 | *Saccharopolyspora erythraea* excisionase (xis) gene, integrase (int) gene, complete cds's and attB site. | *Saccharopolyspora erythraea* | 36,232 | Jul. 6, 1994 |
| | | GB_EST7:W97557 | 267 | W97557 | mf98a09.r1 Soares mouse embryo NbME13.5 14.5 *Mus musculus* cDNA clone IMAGE:422296 5'; mRNA sequence. | *Mus musculus* | 42,969 | Jul. 16, 1996 |
| rxa02060 | | | | | | | | |
| rxa02087 | 1470 | GB_PR3:AC005544 | 169045 | AC005544 | *Homo sapiens* chromosome 17, clone hRPK.349_A_8, complete sequence. | *Homo sapiens* | 35,724 | Sep. 25, 1998 |
| | | GB_PL1:ATF20B18 | 104738 | AL049483 | *Arabidopsis thaliana* DNA chromosome 4, BAC clone F20B18 (ESSA project). | *Arabidopsis thaliana* | 35,890 | Mar. 24, 1999 |
| | | GB_PL2:ATT25K17 | 89904 | AL049171 | *Arabidopsis thaliana* DNA chromosome 4, BAC clone (ESSA project). | *Arabidopsis thaliana* | 38,128 | Aug. 27, 1999 |
| rxa02088 | 1338 | GB_HTG3:AC008697 | 167932 | AC008697 | *Homo sapiens* chromosome 5 clone CIT978SKB_70D3, *** SEQUENCING IN PROGRESS ***, 54 unordered pieces. | *Homo sapiens* | 36,662 | Aug. 3, 1999 |
| | | GB_HTG3:AC008697 | 167932 | AC008697 | *Homo sapiens* chromosome 5 clone CIT978SKB_70D3, *** SEQUENCING IN PROGRESS ***, 54 unordered pieces. | *Homo sapiens* | 36,662 | Aug. 3, 1999 |
| | | GB_HTG3:AC008703 | 213971 | AC008703 | *Homo sapiens* chromosome 5 clone CIT978SKB_76P12, *** SEQUENCING IN PROGRESS ***, 54 unordered pieces. | *Homo sapiens* | 34,768 | Aug. 3, 1999 |
| rxa02159 | 636 | GB_BA2:AF049897 | 9196 | AF049897 | *Corynebacterium glutamicum* N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | *Corynebacterium glutamicum* | 99,843 | Jul. 1, 1998 |
| | | GB_BA2:AF031518 | 2045 | AF031518 | *Corynebacterium glutamicum* ornithine carbamoyltransferase (argF) gene, complete cds. | *Corynebacterium glutamicum* | 88,679 | Jan. 5, 1999 |
| | | GB_BA2:AF041436 | 516 | AF041436 | *Corynebacterium glutamicum* arginine repressor (argR) gene, complete cds. | *Corynebacterium glutamicum* | 100,000 | Jan. 5, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02184 | 504 | GB_BA1:BSZ92953 | 8164 | Z92953 | B. subtilis yws[A,B,C] genes and rbs[A,C,D,K,R] genes. | Bacillus subtilis | 38,951 | Jun. 24, 1998 |
| | | GB_EST36:AI878071 | 593 | AI878071 | fc57a12.y1 Zebrafish WashU MPIMG EST Danio rerio cDNA 5' similar to TR:Q13151 Q13151 HETEROGENEOUS NUCLEAR RIBONUCLEOPROTEIN A0;, mRNA sequence. | Danio rerio | 38,774 | Jul. 21, 1999 |
| | | GB_EST37:AI958166 | 641 | AI958166 | fc91f01.y1 Zebrafish WashU MPIMG EST Danio rerio cDNA 5' similar to TR:Q13151 Q13151 HETEROGENEOUS NUCLEAR RIBONUCLEOPROTEIN A0;, mRNA sequence. | Danio rerio | 36,774 | Aug. 20, 1999 |
| rxa02200 | 1233 | GB_PR3:HSA494O18 | 50502 | AL117328 | Human DNA sequence from clone 494O16 on chromosome 22, complete sequence. | Homo sapiens | 38,648 | Nov. 23, 1999 |
| | | GB_HTG2:AC008161 | 158440 | AC008161 | Mus musculus clone 182_H_5, *** SEQUENCING IN PROGRESS ***, 29 unordered pieces. | Mus musculus | 35,938 | Jul. 28, 1999 |
| rxa02201 | 486 | GB_HTG2:AC008161 | 158440 | AC008161 | Mus musculus clone 182_H_5, *** SEQUENCING IN PROGRESS ***, 29 unordered pieces. | Mus musculus | 35,938 | Jul. 28, 1999 |
| | | GB_EST4:H16949 | 465 | H16949 | ym34a11.r1 Soares infant brain 1NIB Homo sapiens cDNA clone IMAGE:50010 5', mRNA sequence. | Homo sapiens | 38,267 | Jun. 29, 1995 |
| | | GB_EST4:H16949 | 465 | H16949 | ym34a11.r1 Soares infant brain 1NIB Homo sapiens cDNA clone IMAGE:50010 5', mRNA sequence. | Homo sapiens | 36,552 | Jun. 29, 1995 |
| rxa02202 | 762 | GB_IN1:CELC41A3 | 37149 | U41541 | Caenorhabditis elegans cosmid C41A3. | Caenorhabditis elegans | 41,678 | Dec. 8, 1995 |
| | | GB_EST33:AV080151 | 236 | AV080151 | AV080151 Mus musculus stomach C57BL/6J adult Mus musculus cDNA clone 2210413B04, mRNA sequence. | Mus musculus | 43,348 | Jun. 25, 1999 |
| | | GB_GSS5:AQ766877 | 545 | AQ766877 | HS_2017_B2_B08_MR CIT Approved Human Genomic Sperm Library D Homo sapiens genomic clone Plate = 2017 Col = 16 Row = D, genomic survey sequence. | Homo sapiens | 35,568 | Jul. 28, 1999 |
| rxa02205 | 1002 | GB_HTG2:AC005959 | 127587 | AC005959 | Homo sapiens, *** SEQUENCING IN PROGRESS ***, 2 ordered pieces. | Homo sapiens | 40,310 | Nov. 11, 1998 |
| | | GB_HTG2:AC005959 | 127587 | AC005959 | Homo sapiens, *** SEQUENCING IN PROGRESS ***, 2 ordered pieces. | Homo sapiens | 40,310 | Nov. 11, 1998 |
| | | GB_IN1:BRPTUBBA | 4571 | M36380 | B. pahangi beta-tubulin gene, complete cds. | Brugia pahangi | 37,703 | Apr. 26, 1993 |
| rxa02305 | 975 | GB_RO:MUSPAFR | 1140 | D50872 | Mouse gene for platelet activating facter receptor, complete cds. | Mus musculus | 38,420 | Feb. 10, 1999 |
| | | GB_PR3:HUMARL1A | 1008 | L28997 | Homo sapiens ARL1 mRNA, complete cds. | Homo sapiens | 42,188 | Jan. 13, 1995 |
| | | GB_BA1:MLCB2533 | 40245 | AL035310 | Mycobacterium leprae cosmid B2533. | Mycobacterium leprae | 42,000 | Aug. 27, 1999 |
| rxa02431 | 899 | GB_EST4:H35255 | 407 | H35255 | EST111890 Rat PC-12 cells, NGF-treated (9 days) Rattus sp. cDNA clone RPNCO03. mRNA sequence. | Rattus sp. | 39,098 | Apr. 2, 1998 |
| | | GB_HTG1:HS791K14 | 155318 | AL035685 | Homo sapiens chromosome 20 clone RP4-791K14, *** SEQUENCING IN PROGRESS ***, in unordered pieces. | Homo sapiens | 39,456 | Nov. 23, 1999 |
| | | GB_HTG1:HS791K14 | 155318 | AL035685 | Homo sapiens chromosome 20 clone RP4-791K14, *** SEQUENCING IN PROGRESS ***, in unordered pieces. | Homo sapiens | 39,456 | Nov. 23, 1999 |
| rxa02446 | 558 | GB_BA2:AF036166 | 895 | AF036166 | Xanthomonas campestris organic hydroperoxide resistance protein (ohr) gene, complete cds. | Xanthomonas campestris | 49,369 | May 19, 1998 |
| | | GB3EST5:N25122 | 620 | N25122 | yx19d10.r1 Soares melanocyte 2NbHM Homo sapiens cDNA clone IMAGE:262195 5', mRNA sequence. | Homo sapiens | 35,417 | Dec. 28, 1995 |
| | | GB_EST5:N25122 | 620 | N25122 | yx19d10.r1 Soares melanocyte 2NbHM Homo sapiens cDNA clone IMAGE:262195 5', mRNA sequence. | Homo sapiens | 37,172 | Dec. 28, 1995 |
| rxa02541 | 1308 | GB_BA2:DPU93358 | 1267 | U93358 | Deinococcus proteolyticus 40 kDa heat shock chaperone protein (dnaJ) gene, complete cds. | Deinococcus proteolyticus | 42,115 | Jan. 17, 1998 |
| | | GB_EST30:AI658096 | 343 | AI658096 | fc14c09.y1 Zebrafish WashU MPIMG EST Danio rerio cDNA 5' similar to SW:DNJ2_HUMAN P31689 DNAJ PROTEIN HOMOLOG 2. ;, mRNA sequence. | Danio rerio | 52,059 | May 6, 1999 |
| | | GB_EST37:AI959242 | 545 | AI959242 | fd25h11.y1 Zebrafish WashU MPIMG EST Danio rerio cDNA 5' similar to SW:DNJ2_HUMAN P31689 DNAJ PROTEIN HOMOLOG 2. ;, mRNA sequence. | Danio rerio | 45,438 | Aug. 20, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02542 | 777 | EM_PAT:E10832 | 1856 | E10832 | DNA encoding Dnak protein which is one of heat shock protein from | *Corynebacterium gluamicum* | 99,000 | Oct. 8, 1997 (Rel. 52, Created) |
| | | GB_EST24:Z82017 | 396 | Z82017 | SSZ82017 Porcine small intestine cDNA library *Sus scrofa* cDNA clone c12c06 5' similar to eukaryotic initiation factor 4 gamma, mRNA sequence. | *Sus scrofa* | 37,067 | Apr. 30, 1999 |
| | | GB_OM:CATERYTHRO | 681 | L10606 | Cat erythropoietin mRNA, 3' end. | *Felis catus* | 39,409 | Oct. 14, 1993 |
| rxa02543 | 1977 | EM_PAT:E10832 | 1856 | E10832 | DNA encoding Dnak protein which is one of heat shock protein from | *Corynebacterium gluamicum* | 97,306 | Oct. 8, 1997 (Rel. 52, Created) |
| | | GB_BA1:MPHSP70 | 2179 | X59437 | *M. paratuberculosis* gene for 70 kD heat shock protein. | *Mycabacterium avium* subsp. *paratuberculosis* | 73,404 | Apr. 23, 1992 |
| | | GB_BA1:MTY13E10 | 35019 | Z95324 | *Mycobacterium tuberculosis* H37Rv complete genome; segment 18/162. | *Mycobacterium tuberculosis* | 72,028 | Jun. 17, 1998 |
| rxa02586 | 393 | GB_IN2:AC006472 | 156362 | AC006472 | *Drosophila melanogaster*, chromosome 2R, region 45E1-46A2, BAC clone BACR48G21, complete sequence. | *Drosophila melanogaster* | 37,958 | Jan. 30, 1999 |
| | | GB_HTG4:AC010020 | 106541 | AC010020 | *Drosophila melanogaster* chromosome 3L/66D10 clone RPCI98-26I3, **** SEQUENCING IN PROGRESS ****, 55 unordered pieces. | *Drosophila melenogaster* | 37,333 | Oct. 16, 1999 |
| | | GB_HTG4:AC010020 | 106541 | AC010020 | *Drosophila melanogaster* chromosome 3L/66D10 clone RPCI98-26I3, **** SEQUENCING IN PROGRESS ****, 55 unordered pieces. | *Drosophila melanogaster* | 37,333 | Oct. 16, 1999 |
| rxa02587 | 2214 | GB_BA1:MLCL622 | 42498 | Z95398 | *Mycobacterium leprae* cosmid L622. | *Mycobacterium leprae* | 39,848 | Jun. 24, 1997 |
| | | GB_RO:AF074879 | 3316 | AF074879 | *Rattus narvegicus* testis-specific protein TSPY gene, complete cds. | *Rattus norvegicus* | 35,830 | Jul. 6, 1998 |
| | | GB_RO:RNJ001380 | 2641 | AJ001380 | *Rattus norvegicus* Tspy partial genomic sequence exons 1–6. | *Rattus norvegicus* | 37,702 | Jun. 29, 1998 |
| rxs03217 | 331 | GB_BA1:MLCB2548 | 38916 | AL023093 | *Mycrobacterium leprae* cosmid B2548 | *Mycobacterium leprae* | 37,888 | Aug. 27, 1999 |
| | | GB_HTG2:HSI662M14 | 174772 | AL079336 | *Homo sapiens* chromosome 20 clone RP4-662M14, **** SEQUENCING IN PROGRESS ****, 10 unordered pieces. | *Homo sapiens* | 36,420 | Feb. 4, 2000 |
| | | GB_HTG2:HSI662M14 | 174772 | AL079336 | *Homo sapiens* chromosome 20 clone RP4-662M14, **** SEQUENCING IN PROGRESS ****, 10 unordered pieces. | *Homo sapiens* | 35,962 | Feb. 4, 2000 |

SEQUENCE LISTING (306 sequences)

SEQ ID NO: 1 - DNA, 1566 bp, Corynebacterium glutamicum
  CDS (101)..(1543): RXA01524
ttgtggcactctttagtagttttttctcatagctcagtttcgcaactttagagaactctagaaactgagcttcatgctgtgaaaggccttttctccattcatggattcccaaattaatactcagacctctccggcagctgcgaagctgcctagggaggtcgttgttgttctttcgatcctcgtggtttccgcgatgatcatgattcttaatgaaaccattctgtcggttgcgttgccttccatcatggaagatttctccgtgcctgaaactactgcacagtggttgaccactggctttatgttgacgatggcagtggtgattccaactactggttatctgcttgatcgtttttccactaagacgatctttgttactgcgttgttgttctttacggttggtacgttgactgcggcgttggctccaacgtttgcggtgctgcttggtgctcgtatcgttcaggcggttggtactgcgctggtgatgcctttgctgatgacggttacgttgacggtggttcctgcggagcgtcgtggttcgatgatgggcattatttccatcgtgatttctgttgcgccggcgcttggtcctacgttgtctggtgtcattcttaactctttgacctggcactggttgttttggatgatgcttccgatcgttgttatcgctttggtaattggtttcttcttgatcaaaaatatcggcgaaaccaagatcaccccactggatgttctgtctgtcatcctttcggtgtttgccttcggtggtttggtgtacggcttcagttccttcggagcaatcctggagggcgaaggcaccgtaggtatcttcgcgatcgtcgttggcgccatcgcactcctcatctttgctttgcgacagcaccaactcggcaagcaagacaaagcactgatggatctccgagccttcaaggtgaggaacttcagcttctccttgaccaccatccttttggcgttcggcgcgatgctcggaaccgtcatggttttgccaatctacctgcagacttccctcggagttactgctttggtgaccggtttggttgttatgcccggcggcctcctccagggtctgatcagcccattcatcggacgtttctacgacaaggtcggtccacgtccgctgctgattcccggagcaattgcgctggctatcgcggcatcctcgatgacttttctcaatgagaattcacccgtgtggatggtcgtggtcatgcacgttgtgttcagcatcggcatgtgtttgatgatgacccctctcatgaccaccgctctcggcgcccttccgaagcacctctatggtcacggctccgcaattttgaacacgttccaacagctcgcaggcgcagccggaacagcgatcatgattgcagcactttccttcggcacttccattgcagcgtcttcgggatctgcgcatgctgaagctgttgccgctggtaccaaggttgcgttcatcgcaggcgcaatcatcgcggtgatcgctttggttgtttccctcttcgtcactcgcgtcgaggaagaagctcactaaataccaaaaaatggggcaga

SEQ ID NO: 2 - protein, 481 aa, Corynebacterium glutamicum
MDSQINTQTSPAAAKLPREVVVVLSILVVSAMIMILNETILSVALPSIMEDFSVPETTAQWLTTGFMLTMAVVIPTTGYLLDRFSTKTIFVTALLFFTVGTLTAALAPTFAVLLGARIVQAVGTALVMPLLMTVTLTVVPAERRGSMMGIISIVISVAPALGPTLSGVILNSLTWHWLFWMMLPIVVIALVIGFFLIKNIGETKITPLDVLSVILSVFAFGGLVYGFSSFGAILEGEGTVGIFAIVVGAIALLIFALRQHQLGKQDKALMDLRAFKVRNFSFSLTTILLAFGAMLGTVMVLPIYLQTSLGVTALVTGLVVMPGGLLQGLISPFIGRFYDKVGPRPLLIPGAIALAIAASSMTFLNENSPVWMVVVMHVVFSIGMCLMMTPLMTTALGALPKHLYGHGSAILNTFQQLAGAAGTAIMIAALSFGTSIAASSGSAHAEAVAAGTKVAFIAGAIIAVIALVVSLFVTRVEEEAH

SEQ ID NO: 3 - DNA, 371 bp, Corynebacterium glutamicum
  CDS (52)..(348): RXA00497
tggaaacccacaaccggcacacacaaaatttttctcatggagggattcaccgtggcaaacgtcaacatcaagccgcttgaggacaagatcctcgttcagatcaacgaagcagagaccaccaccgcttccggcctggtcattccagattccgctaaggaaaagccacaagaggcaaccgttatcgcagttggcccaggccgcttcgatgacaagggtaaccgcatcccactggacatcaaggaagatgacgttgtgatcttctcccgttacggcggcaccgagatcaagttcggtggcgtggagtacttgcttctctccgctcgtgacatcctcgcaatcgtcgagaagtaggggataagttcatggcaaag

SEQ ID NO: 4 - protein, 99 aa, Corynebacterium glutamicum
VANVNIKPLEDKILVQINEAETTTASGLVIPDSAKEKPQEATVIAVGPGRFDDKGNRIPLDIKEDDVVIFSRYGGTEIKFGGVEYLLLSARDILAIVEK

SEQ ID NO: 5 - DNA, 1737 bp, Corynebacterium glutamicum
  CDS (101)..(1714): RXN00493
cccgttacggcggcaccgagatcaagttcggtggcgtggagtacttgcttctctccgctcgtgacatcctcgcaatcgtcgagaagtaggggataagttcatggcaaagctcattgcttttgaccaggacgcccgcgaaggcattctccggggcgttgacgctctggcaaacgctgtcaaggtaaccctcggcccacgcggccgtaacgtggttcttgataaggcattcggcggacctctggtcaccaacgacggtgtcaccattgcccgcgacatcgaccttgaggatccttttgagaacctcggtgcgcagctggtgaagtccgttgctgttaagaccaacgacatcgctggtgacggcaccacgactgcaactctgcttgctcaggcactcattgctgaaggcctgcgcaacgttgctgctggcgcaaacccaatggagctcaacaagggtatttctgcagctgcagaaaagaccttggaagagttgaaggcacgcgcaaccgaggtgtctgacaccaaggaaatcgcaaacgtcgctaccgtttcatcccgcgatgaagttgtcggcgagatcgttgctgcagcgatggaaaaggttggcaaggacggtgtcgtcaccgttgaggagtcccagtccatcgagactgctctcgaggtcaccgaaggtatttctttcgacaagggctacctttccccttatttcatcaacgacaacgacactcagcaggctgtcctggacaaccctgcagtgctgcttgttcgcaacaagatttcttccctcccagacttcctcccattgctggagaaggttgtggagtccaaccgtcctttgctgatcatcgcagaagacgtcgagggcgagcctttgcagaccctggttgtgaactccatccgcaagaccatcaaggtcgttgcagtgaagtccccttacttcggtgaccgacgcaaggcgttcatggatgacctggctattgtcaccaaggcaactgtcgtggatccagaagtgggcatcaacctcaacgaagctggcgaagaagttttcggtaccgcacgccgcatcaccgtttccaaggacgaaaccatcatcgttgatggtgcaggttccgcagaagacgttgaagcacgtcgcggccagatccgtcgcgaaatcgccaacaccgattccacctgggatcgcgaaaaggcagaagagcgtttggctaagctctccggtggtattgctgtcatccgcgttggtgcagcaactgaaaccgaagtcaacgaccgcaagctgcgtgtcgaagatgccatcaacgctgctcgcgcagcagcacaagaaggcgttatcgctggtggcggttccgctttggttcagatcgctgagactctgaaggcttacgccgaagagttcgaaggcgaccagaaggtcggcgttcgcgcactggctactgctttgggcaagccagcgtactggatcgcctccaacgcaggtcttgacggctctgttgttgttgcacgcactgctgctctgccaaacggcgagggcttcaacgctgcaactttggaatacggaaacctgatcaacgacggtgtcatcgacccagtcaaggtcacccattccgcagtagtgaatgcaacctctgttgcacgcatggttctgaccactgaggcttctgttgttgagaagcctgcagaagaagcagccgatgcacatgcaggacatcatcaccactaaagttctgtgaaaaacaccgt

SEQ ID NO: 6 - protein, 538 aa, Corynebacterium glutamicum
MAKLIAFDQDAREGILRGVDALANAVKVTLGPRGRNVVLDKAFGGPLVTNDGVTIARDIDLEDPFENLGAQLVKSVAVKTNDIAGDGTTTATLLAQALIAEGLRNVAAGANPMELNKGISAAAEKTLEELKARATEVSDTKEIANVATVSSRDEVVGEIVAAAMEKVGKDGVVTVEESQSIETALEVTEGISFDKGYLSPYFINDNDTQQAVLDNPAVLLVRNKISSLPDFLPLLEKVVESNRPLLIIAEDVEGEPLQTLVVNSIRKTIKVVAVKSPYFGDRRKAFMDDLAIVTKATVVDPEVGINLNEAGEEVFGTARRITVSKDETIIVDGAGSAEDVEARRGQIRREIANTDSTWDREKAEERLAKLSGGIAVIRVGAATETEVNDRKLRVEDAINAARAAAQEGVIAGGGSALVQIAETLKAYAEEFEGDQKVGVRALATALGKPAYWIASNAGLDGSVVVARTAALPNGEGFNAATLEYGNLINDGVIDPVKVTHSAVVNATSVARMVLTTEASVVEKPAEEAADAHAGHHHH

SEQ ID NO: 7 - DNA, 1339 bp, Corynebacterium glutamicum
  CDS (101)..(1339): FRXA00498
cccgttacggcggcaccgagatcaagttcggtggcgtggagtacttgcttctctccgctcgtgacatcctcgcaatcgtcgagaagtaggggataagttcatggcaaagctcattgcttttgaccaggacgcccgcgaaggcattctccggggcgttgacgctctggcaaacgctgtcaaggtaaccctcggcccacgcggccgtaacgtggttcttgataaggcattcggcggacctctggtcaccaacgacggtgtcaccattgcccgcgacatcgaccttgaggatccttttgagaacctcggtgcgcagctggtgaagtccgttgctgttaagaccaacgacatcgctggtgacggcaccacgactgcaactctgcttgctcaggcactcattgctgaaggcctgcgcaacgttgctgctggcgcaaacccaatggagctcaacaagggtatttctgcagctgcagaaaagaccttggaagagttgaaggcacgcgcaaccgaggtgtctgacaccaaggaaatcgcaaacgtcgctaccgtttcatcccgcgatgaagttgtcggcgagatcgttgctgcagcgatggaaaaggttggcaaggacggtgtcgtcaccgttgaggagtcccagtccatcgagactgctctcgaggtcaccgaaggtatttctttcgacaagggctacctttccccttatttcatcaacgacaacgacactcagcaggctgtcctggacaaccctgcagtgctgcttgttcgcaacaagatttcttccctcccagacttcctcccattgctggagaaggttgtggagtccaaccgtcctttgctgatcatcgcagaagacgtcgagggcgagcctttgcagaccctggttgtgaactccatccgcaagaccatcaaggtcgttgcagtgaagtccccttacttcggtgaccgacgcaaggcgttcatggatgacctggctattgtcaccaaggcaactgtcgtggatccagaagtgggcatcaacctcaacgaagctggcgaagaagttttcggtaccgcacgccgcatcaccgtttccaaggacgaaaccatcatcgttgatggtgcaggttccgcagaagacgttgaagcacgtcgcggccagatccgtcgcgaaatcgccaacaccgattccacctgggatcgcgaaaaggcagaagagcgtttggctaagctctccggtggtattgctgtcatccgcgttggtgcagcaactgaaaccgaagtcaacgaccgcaagctgcgtgtcgaagatgccatcaacgctgctcgcgcagcagcacaagaaggcgttatcgctggtggc

SEQ ID NO: 8 - protein, 413 aa, Corynebacterium glutamicum
MAKLIAFDQDAREGILRGVDALANAVKVTLGPRGRNVVLDKAFGGPLVTNDGVTIARDIDLEDPFENLGAQLVKSVAVKTNDIAGDGTTTATLLAQALIAEGLRNVAAGANPMELNKGISAAAEKTLEELKARATEVSDTKEIANVATVSSRDEVVGEIVAAAMEKVGKDGVVTVEESQSIETALEVTEGISFDKGYLSPYFINDNDTQQAVLDNPAVLLVRNKISSLPDFLPLLEKVVESNRPLLIIAEDVEGEPLQTLVVNSIRKTIKVVAVKSPYFGDRRKAFMDDLAIVTKATVVDPEVGINLNEAGEEVFGTARRITVSKDETIIVDGAGSAEDVEARRGQIRREIANTDSTWDREKAEERLAKLSGGIAVIRVGAATETEVNDRKLRVEDAINAARAAAQEGVIAGG

SEQ ID NO: 9 - DNA, 723 bp, Corynebacterium glutamicum
  CDS (101)..(700): RXA01217
gcgctgcctgcgaagactcgaccaagacattcgagtcggtcgcgggcattttttattttcgcggccgagtgtccaccttcatccatgaggagaaatcactatggcaaagtaccaaaccattgaggctgctgtccgctctgagttcggcaagggctctgcacgtcgtgcacgcgttgctggccagatccctgctgttgtttacggcgcagatgttgagtccaacctgcacgtcaccatcgaccaccgcaccttcgctgcgctggttcgccaggaaggcgtaaacgctgttcttgagctcgacatcgagggccagaagcagctcaccatgatcaagcacatcgaccagaacgtgctgaccttccacatcgaccacttggacctgcttgccattaagcgcggcgaaaaggttgaggttgacgttccagttatcgtcgagggcgagccagctccaggcaccatgtgggttcaggatgctgacaccatcaaggttgaggctgacgttctgtccatccctgaagagttcaccgtttccatcgaaggccttgagctcggcgcacagatcaccgcagctgacatcaagctcgagggcgacaccaccctggttgaggatcctgagaccctcatcgtcaacatcgttctcccagctgtcgaggaagaagacaccgaagaggacgaagcagctgaagaagcagctactgagtaagcttttttagatagctttat

SEQ ID NO: 10 - protein, 200 aa, Corynebacterium glutamicum
MAKYQTIEAAVRSEFGKGSARRARVAGQIPAVVYGADVESNLHVTIDHRTFAALVRQEGVNAVLELDIEGQKQLTMIKHIDQNVLTFHIDHLDLLAIKRGEKVEVDVPVIVEGEPAPGTMWVQDADTIKVEADVLSIPEEFTVSIEGLELGAQITAADIKLEGDTTLVEDPETLIVNIVLPAVEEEDTEEDEAAEEAATE

SEQ ID NO: 11 - DNA, 1603 bp, Corynebacterium glutamicum
  CDS (33)..(1580): RXA00605
ataggtaaccctcataaaaggaaggaatgctaatgtctgagaagtcagcagcagaccagatcgtagatcgcggaatgcgtccaaagctttctggaaacactacccgccacaacggagcaccagttccatctgagaacatctccgcaaccgcaggcccacagggtccaaacgttctcaatgacattcacctcattgaaaagctcgcacactttaaccgcgagaacgttccagagcgtatccctcacgcaaagggccacggcgctttcggtgagctgcacatcaccgaggacgtatccgaatacaccaaggcagacctgttccagcctggtaaggtcaccccgctggctgttcgcttctctactgttgctggtgagcagggctccccagatacctggcgcgacgtccacggcttcgctcttcgcttctacaccgaagagggcaactacgacatcgtgggtaacaacaccccaaccttcttccttcgtgacggcatgaagttcccggacttcatccactcacagaagcgtctcaacaagaacggtctgcgcgatgcagacatgcagtgggatttctggacccgcgcacctgaatctgcacaccaggtgacctacctgatgggtgaccgcggtacccctaagacctcccgccaccaggacggcttcggctcccacaccttccagtggatcaacgctgaaggtaagccagtttgggttaagtaccacttcaagacccgccagggctgggattgcttcaccgatgcagaagcagcaaaggttgcaggcgagaacgctgactaccagcgcgaagacctctacaacgctattgaaaacggcgacttcccaatctgggacgtcaaggttcagatcatgcctttcgaggatgcagagaactaccgctggaacccattcgacctgaccaagacctggtcccagaaggattacccactgatcccagtcggttacttcatcctgaaccgcaacccacgcaacttcttcgctcagatcgagcagcttgcactggatccaggcaacatcgttcctggcgtcggcctgtccccagaccgcatgctccaggcacgtatcttcgcatacgctgaccagcagcgttaccgcatcggcgctaactaccgcgacctgccagtgaaccgtccaatcaacgaggtcaacacctacagccgcgaaggttccatgcagtacatcttcgacgctgagggcgagccttcctacagccctaaccgctacgacaagggcgcaggctacctggataacggtacggattcctcctccaaccacacctcctacggccaggctgatgacatctacgtcaacccagacccacacggcaccgacctggttcgtgctgcttacgtcaagcaccaggatgatgacgacttcatccagccaggcatcctataccgcgaggtcctggatgagggcgagaaggagcgattggcagacaacatctccaacgcaatgcagggcatctctgaggcaaccgagccacgcgtctacgactactggaacaacgttgatgagaacctcggcgctcgcgtcaaggagctttacctccagaagaaggcttaagtccttctgatttaaaatga

SEQ ID NO: 12 - protein, 516 aa, Corynebacterium glutamicum
MSEKSAADQIVDRGMRPKLSGNTTRHNGAPVPSENISATAGPQGPNVLNDIHLIEKLAHFNRENVPERIPHAKGHGAFGELHITEDVSEYTKADLFQPGKVTPLAVRFSTVAGEQGSPDTWRDVHGFALRFYTEEGNYDIVGNNTPTFFLRDGMKFPDFIHSQKRLNKNGLRDADMQWDFWTRAPESAHQVTYLMGDRGTPKTSRHQDGFGSHTFQWINAEGKPVWVKYHFKTRQGWDCFTDAEAAKVAGENADYQREDLYNAIENGDFPIWDVKVQIMPFEDAENYRWNPFDLTKTWSQKDYPLIPVGYFILNRNPRNFFAQIEQLALDPGNIVPGVGLSPDRMLQARIFAYADQQRYRIGANYRDLPVNRPINEVNTYSREGSMQYIFDAEGEPSYSPNRYDKGAGYLDNGTDSSSNHTSYGQADDIYVNPDPHGTDLVRAAYVKHQDDDDFIQPGILYREVLDEGEKERLADNISNAMQGISEATEPRVYDYWNNVDENLGARVKELYLQKKA

SEQ ID NO: 13 - DNA, 2439 bp, Corynebacterium glutamicum
  CDS (101)..(2416): RXA00404
aagatccgatcatcggcatacagaaacacccatctggccgaactttcctttttctgcatgcatttctgcacacagtttctgcccgctgtttctacgcatagtggctttgaaacgacccgaagagaaaacagtaaagatcgtgaccataaaacagactgacaacatcaatgacgatgatttggtgtacagcaacgctactgaccttccagtaggcgtgaagaagtcccctaaaatgtcaccgaccgcccgcgttggtctccttgtctttggggttatcgcggcggtgggttggggagcaatcgctttctcccgtggcgaaacaatcaactctgtgtggctggttttggcggcagttggttcctatatcattgcgttttctttctatgcccgactgattgaatacaaagttgttaagccgaaagatcagcgagcaaccccggcggaatacgttaatgacggcaaggactatgtcccaacggatcgtcgtgtgctttttggccaccactttgcagctattgcaggtgccggtccattggttggacctgtcatggccgcgcagatgggctacctgccaggcaccttgtggattatcctcggtgtgattttcgccggtgcagtgcaggactacctagtgctgtgggtgtctactcgtaggcgtggacgctcacttggccagatggttcgtgatgaaatgggcacggtcggtggagctgccggtatcttggcgaccatctccatcatgatcatcattatcgcggtgctcgcattgatcgtggttaatgcactggctgattcaccatggggcgttttctccatcaccatgaccatcccaattgcactgttcatgggtgtgtacttgcgttacctgcgcccaggtcgtgttactgaagtgtccatcatcggtgtggcactgctcctgctggctatcgttgctggtggttgggttgcagacacctcatggggcgtggaatggttcacctggtctaagaccactttggcgttggccttgatcggttacggaatcatggctgcgattttgccggtgtggctgctgcttgcaccgcgcgattacctgtctacctttatgaagatcggcgtcatcggtctgttggcagtgggtattttgttcgcacgtcctgaggtgcagatgccttccgtgacctccttcgcacttgagggcaacggtccggtgttctctggaagtctgttcccattcctgttcatcacgattgcctgtggtgcactgtctggtttccacgcactgatttcttcaggaaccacaccaaagcttgtggagaaggaatcccagatgcgcatgctcggctacggcggcatgttgatggaatctttcgtggcgatgatggcactgatcaccgctgttattctggatcgtcacctgtacttctccatgaacgctccgctggcactgactggtggagatccagcaaccgcagctgagtgggttaactccattgggctgacaggtgcggatatcaccccggaacagctgtcggaagctgctgaaagtgtcggagaatccactgttatttcccgtaccggtggcgcaccaaccttggcgttcggtatgtctgaaatcctctccggattcatcggcggcgctggaatgaaggcgttctggtaccacttcgccatcatgtttgaggctctgttcatcctcactactgtggatgcaggtactcgtgtggctcgctttatgatgaccgataccttgggcaatgttccaggtctgcgccgtttcaaggatccttcatggactgtcggtaactggatttctaccgtgtttgtgtgtgctctatggggtgctattttgctcatgggtgttaccgatccactgggcggcatcaacgtgcttttcccactattcggtatcgctaaccagctgctcgccgctattgcacttgctctcgtgctggttgttgtggtgaagaagggcctgtacaagtgggcgtggattccagctgttcctttggcatgggatctcattgtcacgatgactgcgtcatggcagaagattttccactctgatccggctattggctactgggctcagaacgcgaacttccgcgatgcaaagtctcaaggccttaccgaatttggtgccgctaaatctcctgaggcaatcgatgcggttatccgaaacaccatgattcagggcatcttgtccatcctgttcgcggtgctcgtcctcgttgttgtcggcgcagccattgcggtgtgcatcaagtccatcagggctcgtgcagccggaacacctttggagaccactgaagagcctgatactgaatctgagttcttcgccccaactggattccttgcatcttccagggataaggaagtccaggccatgtgggacgagcgctacccaggcggtgcgcccgtgtcttctggagggcactaaaacatgatggctcttactca

SEQ ID NO: 14 - protein, 772 aa, Corynebacterium glutamicum
VALKRPEEKTVKIVTIKQTDNINDDDLVYSNATDLPVGVKKSPKMSPTARVGLLVFGVIAAVGWGAIAFSRGETINSVWLVLAAVGSYIIAFSFYARLIEYKVVKPKDQRATPAEYVNDGKDYVPTDRRVLFGHHFAAIAGAGPLVGPVMAAQMGYLPGTLWIILGVIFAGAVQDYLVLWVSTRRRGRSLGQMVRDEMGTVGGAAGILATISIMIIIIAVLALIVVNALADSPWGVFSITMTIPIALFMGVYLRYLRPGRVTEVSIIGVALLLLAIVAGGWVADTSWGVEWFTWSKTTLALALIGYGIMAAILPVWLLLAPRDYLSTFMKIGVIGLLAVGILFARPEVQMPSVTSFALEGNGPVFSGSLFPFLFITIACGALSGFHALISSGTTPKLVEKESQMRMLGYGGMLMESFVAMMALITAVILDRHLYFSMNAPLALTGGDPATAAEWVNSIGLTGADITPEQLSEAAESVGESTVISRTGGAPTLAFGMSEILSGFIGGAGMKAFWYHFAIMFEALFILTTVDAGTRVARFMMTDTLGNVPGLRRFKDPSWTVGNWISTVFVCALWGAILLMGVTDPLGGINVLFPLFGIANQLLAAIALALVLVVVVKKGLYKWAWIPAVPLAWDLIVTMTASWQKIFHSDPAIGYWAQNANFRDAKSQGLTEFGAAKSPEAIDAVIRNTMIQGILSILFAVLVLVVVGAAIAVCIKSIRARAAGTPLETTEEPDTESEFFAPTGFLASSRDKEVQAMWDERYPGGAPVSSGGH

SEQ ID NO: 15 - DNA, 255 bp, Corynebacterium glutamicum
  CDS (101)..(232): RXN03119
tgggaggtgtcgcaccaagtacttttgcgaagcgccatctgacggattttcaaaagatgtatatgctcggtgcggaaacctacgaaaggattttttacccatggctgtatacgaactcccagaactcgactacgcatacgacgctctcgagccacacatcgtcgctgaaatcatggagcttgaccagtccaaggaccacgcaacctacgttgcgggcgcaaatgcagcactctaggcactagagaaggcacgcga

SEQ ID NO: 16 - protein, 44 aa, Corynebacterium glutamicum
MAVYELPELDYAYDALEPHIVAEIMELDQSKDHATYVAGANAAL

SEQ ID NO: 17 - DNA, 249 bp, Corynebacterium glutamicum
  CDS (101)..(226): RXN03120
ctgggcagttcttgggtacgaccacatatccggtcgcctggttatcgagcagctcaccgaccaggagggcaacatctccttcgacatcaccccagttctgatgctcgatatgtgggagcacgctttctacctgcagtacatgaacgttaaggcagattacgtcaaggctgtttggaacgtcttcaactgggacgacgcaagagcacgcttcgcagcagcttccaagtaagcatttttagtccgtgcaat

SEQ ID NO: 18 - protein, 42 aa, Corynebacterium glutamicum
MLDMWEHAFYLQYMNVKADYVKAVWNVFNWDDARARFAAASK

SEQ ID NO: 19 - DNA, 660 bp, Corynebacterium glutamicum
  CDS (101)..(637): RXN00575
gaagcgtccgcaggcaagaaaacgtcccggaaaacggcgataggggtcacccgcgcatgtccggttgccgatctatttaaataccaggacaattgcgtgcatggttgaaagagacttcactatccgaccaatccgcgagggtgatttccctcaggtgagggacatctacgaattgggcctggagacgggacatgcgacttatgagacttctggtcccacgtgggaccagttctcccaatctaaaatcatggataccgtcatggtggcggtagaaaacaacgacccggacttcatcctcggatgggtgtctgctgctccaatttcaagccgacaggttttccatggagtggtggaagattccatctatatccacccccagggccaaggccgaggaatcggcggcgctttgctcgacgcccttatcacctactgcgaaagcaacggcatctggtcgatccactcctggatcttcccggaaaacctcggttctgcgaaactgcatgaatcgaagggcttcgtgaaggtgggcaccatgcaccaaatggcaaggatgccctacggcgagatggaaggacaatggcgcgattgtgatctgtgggagtgcctcttatccgttccagagcaagctcaaagttcctaaagcaatttaaatctgacttt

SEQ ID NO: 20 - protein, 179 aa, Corynebacterium glutamicum
MVERDFTIRPIREGDFPQVRDIYELGLETGHATYETSGPTWDQFSQSKIMDTVMVAVENNDPDFILGWVSAAPISSRQVFHGVVEDSIYIHPQGQGRGIGGALLDALITYCESNGIWSIHSWIFPENLGSAKLHESKGFVKVGTMHQMARMPYGEMEGQWRDCDLWECLLSVPEQAQSS

SEQ ID NO: 21 - DNA, 606 bp, Corynebacterium glutamicum
  CDS (101)..(583): FRXA00575
gcatgtccggttgccgatctatttaaataccaggacaattgcgtgcatggttgaaagagacttcactatccgaccaatccgcgagggtgatttccctcaggtgagggacatctacgaattgggcctggagacgggacatgcgacttatgagacttctggtcccacgtgggaccagttctcccaatctaaaatcatggataccgtcatggtggcggtagaaaacaacgacccggacttcatcctcggatgggtgtctgctgctccaatttcaagccgacaggttttccatggagtggtggaagattccatctatatccacccccagggccaaggccgaggaatcggcggcgctttgctcgacgcccttatcacctactgcgaaagcaacggcatctggtcgatccactcctggatcttcccggaaaacctcggttctgcgaaactgcatgaatcgaagggcttcgtgaaggtgggcaccatgcaccaaatggcaaggatgccctacggcgagatggaaggacaatggcgcgattgtgatctgtgggagtgcctcttatccgttccagagcaagctcaaagttcctaaagcaatttaaatctgacttt

SEQ ID NO: 22 - protein, 161 aa, Corynebacterium glutamicum
VRDIYELGLETGHATYETSGPTWDQFSQSKIMDTVMVAVENNDPDFILGWVSAAPISSRQVFHGVVEDSIYIHPQGQGRGIGGALLDALITYCESNGIWSIHSWIFPENLGSAKLHESKGFVKVGTMHQMARMPYGEMEGQWRDCDLWECLLSVPEQAQSS

SEQ ID NO: 23 - DNA, 1575 bp, Corynebacterium glutamicum
  CDS (101)..(1552): RXN01345
cataacctcattgaacatgcaaaactaatgcttttggggggtatgcataaattcgtttcgttccactgcacagcccgaaaatgctgctagggtcaagttcatgcgttttggacttgacttgggaactacccgcacaatcgcggccgccgtggaccgcggaaactatcccatcgtcactgtggaagattctttaggcgacacccacgatttcattccatctgtggtggccctcaaggcagataggattgtcgcgggttgggatgctattgaggttgggcaggaccacccttccttcgtacgttctttcaaacgcctactctctgaacccaatgtcacggaagccaccccggtctacttgggcgatcatgtacaccctttgggcgccgtcctggaggcttttgcggaaaacgtggtcactgcgctgcgtgcatttcagacgcaattgggagatacctccccgatcgaagtagtcattggtgtgcccgccaactcccacagcgcccagcgactgctcaccatgtccgccttcagcgccacaggcatcaccgttgtcggtttggtcaatgagcccagcgccgcagctttcgagtacacccaccgccacgcccgcaccttaaactccaagcgccaagccatcgtggtttatgatttgggaggcggaacattcgactcctcgctcatccgcatcgacggcacccaccacgaggttgtgtcctccattggcatttcacgccttggtggcgatgatttcgatgaaatcctcctccaatgcgcgctcaaggccgcaggcagacagcacgatgcgtttggcaagcgtgctaaaaacacgcttctcgacgaatcccgcaacgcgaaggaagctcttgttccgcaatcccgtcgcttggttctagaaattggcgacgacgacatcaccgttccagtgaacaagttctacgaggctgccactcccctggtggaaaaatccttgtccatcatggaacccctcatcggcgtcgatgatcttaaagattccgacatcgcaggcatctaccttgttggtggaggatcctcgctcccactcgtttccaggttgctccgcgagcgtttcggccgccgtgtccaccgctccccattcccctcaggttccactgcggtgggtctggccatcgcggctgacccttcctctggtttccacctaagggaccgcgttgcgcgaggcatcggtgtgttccgtgagcacgattctggtcgtgccgtgagctttgacccgctgatcgccccggacaccgattctgcgaccgtggcgaaacgatgctacaaggcggtgcacaacattggttggttcaggttcgtggaatactccaccgtgtccgaggatggcagccccggagatatttccctgctcagtgaaatcaagattccttttgatagctccatcaccgatgtggatgctaccgagatttcacgtttcgatggcccagaagtagaagaaaccatcacagtcaatgacaacggcgtggcttccatttccatcaagatactcggcggcgttaccgtcgagcacacaatttagttaccattttggtgctggtg

SEQ ID NO: 24 - protein, 484 aa, Corynebacterium glutamicum
MRFGLDLGTTRTIAAAVDRGNYPIVTVEDSLGDTHDFIPSVVALKADRIVAGWDAIEVGQDHPSFVRSFKRLLSEPNVTEATPVYLGDHVHPLGAVLEAFAENVVTALRAFQTQLGDTSPIEVVIGVPANSHSAQRLLTMSAFSATGITVVGLVNEPSAAAFEYTHRHARTLNSKRQAIVVYDLGGGTFDSSLIRIDGTHHEVVSSIGISRLGGDDFDEILLQCALKAAGRQHDAFGKRAKNTLLDESRNAKEALVPQSRRLVLEIGDDDITVPVNKFYEAATPLVEKSLSIMEPLIGVDDLKDSDIAGIYLVGGGSSLPLVSRLLRERFGRRVHRSPFPSGSTAVGLAIAADPSSGFHLRDRVARGIGVFREHDSGRAVSFDPLIAPDTDSATVAKRCYKAVHNIGWFRFVEYSTVSEDGSPGDISLLSEIKIPFDSSITDVDATEISRFDGPEVEETITVNDNGVASISIKILGGVTVEHTI

SEQ ID NO: 25 - DNA, 1267 bp, Corynebacterium glutamicum
  CDS (101)..(1267): FRXA01345
cataacctcattgaacatgcaaaactaatgcttttggggggtatgcataaattcgtttcgttccactgcacagcccgaaaatgctgctagggtcaagttcatgcgttttggacttgacttgggaactacccgcacaatcgcggccgccgtggaccgcggaaactatcccatcgtcactgtggaagattctttaggcgacacccacgatttcattccatctgtggtggccctcaaggcagataggattgtcgcgggttgggatgctattgaggttgggcaggaccacccttccttcgtacgttctttcaaacgcctactctctgaacccaatgtcacggaagccaccccggtctacttgggcgatcatgtacaccctttgggcgccgtcctggaggcttttgcggaaaacgtggtcactgcgctgcgtgcatttcagacgcaattgggagatacctccccgatcgaagtagtcattggtgtgcccgccaactcccacagcgcccagcgactgctcaccatgtccgccttcagcgccacaggcatcaccgttgtcggtttggtcaatgagcccagcgccgcagctttcgagtacacccaccgccacgcccgcaccttaaactccaagcgccaagccatcgtggtttatgatttgggaggcggaacattcgactcctcgctcatccgcatcgacggcacccaccacgaggttgtgtcctccattggcatttcacgccttggtggcgatgatttcgatgaaatcctcctccaatgcgcgctcaaggccgcaggcagacagcacgatgcgtttggcaagcgtgctaaaaacacgcttctcgacgaatcccgcaacgcgaaggaagctcttgttccgcaatcccgtcgcttggttctagaaattggcgacgacgacatcaccgttccagtgaacaagttctacgaggctgccactcccctggtggaaaaatccttgtccatcatggaacccctcatcggcgtcgatgatcttaaagattccgacatcgcaggcatctaccttgttggtggaggatcctcgctcccactcgtttccaggttgctccgcgagcgtttcggccgccgtgtccaccgctccccattcccctcaggttccactgcggtgggtctggccatcgcggctgacccttcctctggtttccacctaagggaccgcgttgcgcgaggcatcggtgtgttccgtgagcacgattctggtcgtgccgtgagctttgacccgctgatcgccccggac

SEQ ID NO: 26 - protein, 389 aa, Corynebacterium glutamicum
MRFGLDLGTTRTIAAAVDRGNYPIVTVEDSLGDTHDFIPSVVALKADRIVAGWDAIEVGQDHPSFVRSFKRLLSEPNVTEATPVYLGDHVHPLGAVLEAFAENVVTALRAFQTQLGDTSPIEVVIGVPANSHSAQRLLTMSAFSATGITVVGLVNEPSAAAFEYTHRHARTLNSKRQAIVVYDLGGGTFDSSLIRIDGTHHEVVSSIGISRLGGDDFDEILLQCALKAAGRQHDAFGKRAKNTLLDESRNAKEALVPQSRRLVLEIGDDDITVPVNKFYEAATPLVEKSLSIMEPLIGVDDLKDSDIAGIYLVGGGSSLPLVSRLLRERFGRRVHRSPFPSGSTAVGLAIAADPSSGFHLRDRVARGIGVFREHDSGRAVSFDPLIAPD

SEQ ID NO: 27 - DNA, 1308 bp, Corynebacterium glutamicum
  CDS (101)..(1285): RXA02541
atccgccggtgtccggacaacaaaacttgcaacacaagataacttaagaaattgcatacaattcaccgcatataagactcatggaaggaggggatgcccagtgaacaacagcgaatgggcaaataagaactattacgcagacctgggggtctcctcgtccgcttcagaagatgagatcaaaaaggcttaccgcaagctcgccagggaaaatcacccagataaaaatccaggtgacaaggccgctgaagatcgattcaaaaaagcggccgaggcatatgacgtacttggtgatgacaagaaacgaaaagaatacgacgagctcaaagcacttctagcttctggtggaatccgcggaggattcggaagcggaggtgcgggattccccggcgggtttcgcacgtcgacgggaggattcgacacctcagacctcttcggaggaggacaaggtggagggttttctacggacggcggtttgggcgatatcttcggtggccttttcaaccgcggcgctggttctcaccagtcagctaggccgacgcggggggcggatgtacaaaccgaaataactctctcgtttgttgaggcagcgaaaggcacgaccatcccagtggaactcaccggcgatgcgccctgcaacacctgccacggatcgggctccaaatcaggccaccccgcaaaatgtggaacctgtgatggaaccggattcacctctgagaacaagggtgctttcggattctccgctccatgtgcaacctgtggtggcactggtgaaataatcactgatccttgcgataactgccacggccgaggcaccgtccggaagtctcgttccatcaccgtgcgtatcccaactggtgtggaagatggacagaaagttcgtcttgcaggccaaggcgaagcaggaccaaatggcaaaccagcgggcgatctctttgtgaaagtccacgtgaaaaaggacgatgtgttcacacgcgacggcagcaacattttgatcaccattcccgtgagcttcagcgagctggctttgggtggcgctatttctgtgccaacgctcaacaagcctgtaaaactcaagctacctgcgggaacgccagatggtcgtactttgcgtgtacgcggtcgcggtatcgaagcacgtgattccactggtgatctgctggttacagtccaggtttctgtcccgaagaatctggatgacaacgctgcggaagctctccgcgcatatgctgaagcagaaactaattcaggttttgatccccgcgctaactgggcgggccagaaccgctagacgttctctttgagaaagga

SEQ ID NO: 28 - protein, 395 aa, Corynebacterium glutamicum
VNNSEWANKNYYADLGVSSSASEDEIKKAYRKLARENHPDKNPGDKAAEDRFKKAAEAYDVLGDDKKRKEYDELKALLASGGIRGGFGSGGAGFPGGFRTSTGGFDTSDLFGGGQGGGFSTDGGLGDIFGGLFNRGAGSHQSARPTRGADVQTEITLSFVEAAKGTTIPVELTGDAPCNTCHGSGSKSGHPAKCGTCDGTGFTSENKGAFGFSAPCATCGGTGEIITDPCDNCHGRGTVRKSRSITVRIPTGVEDGQKVRLAGQGEAGPNGKPAGDLFVKVHVKKDDVFTRDGSNILITIPVSFSELALGGAISVPTLNKPVKLKLPAGTPDGRTLRVRGRGIEARDSTGDLLVTVQVSVPKNLDDNAAEALRAYAEAETNSGFDPRANWAGQNR

SEQ ID NO: 29 - DNA, 777 bp, Corynebacterium glutamicum
  CDS (101)..(754): RXA02542
ccaggctgacgcaggtgcagaaggcgctgcagatgacaatgttgttgacgctgaagttgtcgaagacgacgcagctgacaatggtgaggacaagaagtaaatgactacccctaacggaatgcccgacaatcctggggatcctgaaaataccgatccagaggcaacctctgctgatcgtgctgagcaggcagctgaagaagcagctgcccgccaagcggaggaatctccatttggacaggcctcagaggaagaaatttctccagagctcgaagcagagatcaatgatcttctatcagatgttgatccagatttggatggcgatggtgaagtgtccgctgtagaaacacagcttgccgaacgcactgaggatctgcagcgagtcaccgctgagtacgccaactaccgtcgacgtaccgagcgtgaacgccagggcatcatcgacaccgcacgcgcaggtgttgttacccaacttctgccgttgctcgacgatcttgacctggctgaacagcacggtgaccttaacgaaggtccgctgaagtcactgtctgacaagctgatcaacatcctgggtggattgaaggtggaatccttcggcgagatcggcgaagcattcgatccagagatccacgaagcagtacaggatctctcacagggtgatgtcaaggttctgggaacggtactccgcaagggataccgcctcggcgaccgcgtcatccgcaccgcaatggtcctcattggggatccagaggagagctagagagactaagtctcttagtg

SEQ ID NO: 30 - protein, 218 aa, Corynebacterium glutamicum
MTTPNGMPDNPGDPENTDPEATSADRAEQAAEEAAARQAEESPFGQASEEEISPELEAEINDLLSDVDPDLDGDGEVSAVETQLAERTEDLQRVTAEYANYRRRTERERQGIIDTARAGVVTQLLPLLDDLDLAEQHGDLNEGPLKSLSDKLINILGGLKVESFGEIGEAFDPEIHEAVQDLSQGDVKVLGTVLRKGYRLGDRVIRTAMVLIGDPEES

SEQ ID NO: 31 - DNA, 1977 bp, Corynebacterium glutamicum
  CDS (101)..(1954): RXN02543
ctcaatgaggagtttttcttaccggcgaaagtcggtgggaagcaagtcaaagctcaagccgtggacagtactaaaatcacctaaaacaggaggcaccattatgggacgtgcagtaggaattgaccttggaaccaccaactctgtggtttccgtacttgaaggcggcgagccagtagttatcgcaaacgcagaaggctcacgcaccaccccttccgtcgttgcattcgcaaagaacggtgaagttctagtcggccagtccgctaagaaccaggcggtcaccaacgttgaccgcaccattcgctccgtcaagcgccacatcggcaccgactggtccgttgctatcgatgacaagaactacacctcacaggaaatctcggctcgtaccctgatgaagctgaagcgcgacgctgaagcatacctgggcgaggacgtcactgatgctgttattaccgttcctgcatacttcgaggactcacagcgccaggcaaccaaggaagctggtcagatcgcaggccttaacgttctgcgtattgttaacgagccaaccgcggctgcacttgcatacggccttgagaagggcgagcaggagcagaccattctggtattcgacctcggtggcggcaccttcgacgtctccctcctagagatcggcgacggtgttgttgaggttcgcgcaacctccggcgataacgagctcggtggcgacgactgggatcagcgtatcgttgactggctggtagagaagttccagtcctccaacggcattgacctgaccaaggacaagatggccctgcagcgtctgcgtgaggcagctgagaaggcaaagatcgagctgtcctcttcccagagtgcaaacatcaaccttccttacatcaccgttgatgcagacaagaacccactgttcttggatgagaccctttcccgtgccgagttccagcgcatcacccaggacctcctggcccgcaccaagactcctttcaaccaggttgttaaggacgctggcgtgtccgtctcggagatcgaccacgttgttctcgtcggtggttccacccgtatgcctgctgttaccgaactggtcaaggaactgaccggtggacgtgagccaaacaagggtgttaacccagatgaggttgttgcagttggtgcagcacttcaggccggtgttctccgcggcgaggtcaaggatgttcttcttcttgacgtcaccccactgtccctcggcattgagaccaagggtggcgtgatgaccaagctcatcgagcgcaacaccaccatccctaccaagcgttccgagaccttcaccaccgcagaggacaaccagccttctgttcagatccaggtcttccagggcgagcgtgaaatcgcaaccgccaacaagctgctcggatccttcgagctcggcggcatcgcacctgcaccacgtggcgtcccacagatcgaggtcactttcgacatcgacgccaacggcatcgtccacgtcaccgcaaaggacaagggtactggcaaggaaaacaccatcaccattcaggacggctccggtctctcccaggatgaaattgatcgcatgatcaaggatgctgaagctcacgctgatgaggacaagaagcgccgcgaggagcaggaagtccgcaacaacgctgagtccctggtttaccagacccgcaagttcgttgaagagaactccgagaaggtctccgaagacctcaaggcaaaggtcgaagaggcagccaagggcgttgaagaagcactcaagggcgaggacctcgaggcaatcaaggctgcagttgagaagctgaacaccgagtcccaggaaatgggtaaggctatctacgaggctgacgctgctgctggtgcaacccaggctgacgcaggtgcagaaggcgctgcagatgacaatgttgttgacgctgaagttgtcgaagacgacgcagctgacaatggtgaggacaagaagtaaatgactacccctaacggaat

SEQ ID NO: 32 - protein, 618 aa, Corynebacterium glutamicum
MGRAVGIDLGTTNSVVSVLEGGEPVVIANAEGSRTTPSVVAFAKNGEVLVGQSAKNQAVTNVDRTIRSVKRHIGTDWSVAIDDKNYTSQEISARTLMKLKRDAEAYLGEDVTDAVITVPAYFEDSQRQATKEAGQIAGLNVLRIVNEPTAAALAYGLEKGEQEQTILVFDLGGGTFDVSLLEIGDGVVEVRATSGDNELGGDDWDQRIVDWLVEKFQSSNGIDLTKDKMALQRLREAAEKAKIELSSSQSANINLPYITVDADKNPLFLDETLSRAEFQRITQDLLARTKTPFNQVVKDAGVSVSEIDHVVLVGGSTRMPAVTELVKELTGGREPNKGVNPDEVVAVGAALQAGVLRGEVKDVLLLDVTPLSLGIETKGGVMTKLIERNTTIPTKRSETFTTAEDNQPSVQIQVFQGEREIATANKLLGSFELGGIAPAPRGVPQIEVTFDIDANGIVHVTAKDKGTGKENTITIQDGSGLSQDEIDRMIKDAEAHADEDKKRREEQEVRNNAESLVYQTRKFVEENSEKVSEDLKAKVEEAAKGVEEALKGEDLEAIKAAVEKLNTESQEMGKAIYEADAAAGATQADAGAEGAADDNVVDAEVVEDDAADNGEDKK

SEQ ID NO: 33 - DNA, 1977 bp, Corynebacterium glutamicum
  CDS (101)..(1954): FRXA02543; All occurrences of n indicate any nucleotide; All occurrences of Xaa indicate any amino acid
ctcaatgaggagtttttcttaccggcgaaagtcggtgggaagcaagtcaaagctcaagccgtggacagtactaaaatcacctaaaacaggaggcaccattatgggacgtgcagtaggaattgaccttggaaccaccaactctgtggtttccgtacttgaaggcggcgagccagtagttatcgcaaacgcagaaggctcacgcaccaccccttccgtcgttgcattcgcaaagaacggtgaagttctagtcggccagtccgctaagaaccaggcggtcaccaacgttgaccgcaccattcgctccgtcaagcgccacatcggcaccgactggtccgttgctatcgatgacaagaactacacctcacaggaaatctcggctcgtaccctgatgaagctgaagcgcgacgctgaagcatacctgggcgaggacgtcactgatgctgttattaccgttcctgcatacttcgaggactcacagcgccaggcaaccaaggaagctggtcagatcgcaggccttaacgttctgcgtattgttaacgagccaaccgcggctgcacttgcatacggccttgagaagggcgagcaggagcagaccattctggtattcgacctcggtggcggcaccttcgacgtctccctcctagagatcggcgacggtgttgttgaggttcgcgcaacctccggcgataacgagctcggtggcgacgactgggatcagcgtatcgttgactggctggtagagaagttccagtcctccaacggcattgacctgaccaaggacaagatggccctgcagcgtctgcgtgaggcagctgagaaggcaaagatcgagctgtcctcttcccagagtgcaaacatcaaccttccttacatcaccgttgatgcagacaagaacccactgttcttggatgagaccctttcccgtgccgagttccagcgcatcacccaggacctcctggcccgcaccaagactcctttcaaccaggttgttaaggacgctggcgtgtccgtctcggagatcgaccacgttgttctcgtcggtggttccacccgtatgcctgctgttaccgaactggtcaaggaactgaccggtggacgtgagccaaacaagggtgttaacccagatgaggttgttgcagttggtgcagcacttcaggccggtgttctccgcggcgaggtcaaggatgttcttcttcttgacgtcaccccactgtccctcggcattgagaccaagggtggcgtgatgaccaagctcatcgagcgcaacaccaccatccctaccaagcgttccgagaccttcaccaccgcagaggacaaccagccttctgttcagatccaggtcttccagggcgagcgtgaaatcgcaaccgccaacaagctgctcggatccttcgagctcggcggcatcgcacctgcaccacgtggcgtcccacagatcgaggtcactttcgacatcgacgccaacggcatcgtccacgtcaccgcaaaggacaagggtactggcaaggaaaacaccatcaccattcaggacggctccggtctctcccaggatgaaattgatcgcatgatcaaggatgctgaagctcacgctgatgaggacaagaagcgccgcgaggagcaggaagtccgcaacaacgctgagtccctggtttaccagacccgcaagttcgttgaagagaactccgagaaggtctccgaagacctcaaggcaaaggtcgaagaggcagccaagggcgttgaagaagcactcaagggcgaggacctcgaggcaatcaaggctgcagttgagaagctgaacaccgagtcccaggaaatgggtaaggntatctncgaggctgacgctnctgctggtgcaacccaggctgacgcaggtgcagaaggcgctgcagatgacaatgttgttgacgctgaagttgtcgaagacgacgcagctgacaatggtgaggacaagaagtaaatgactacccctaacggaat

SEQ ID NO: 34 - protein, 618 aa, Corynebacterium glutamicum
  All occurrences of Xaa indicate any amino acid
MGRAVGIDLGTTNSVVSVLEGGEPVVIANAEGSRTTPSVVAFAKNGEVLVGQSAKNQAVTNVDRTIRSVKRHIGTDWSVAIDDKNYTSQEISARTLMKLKRDAEAYLGEDVTDAVITVPAYFEDSQRQATKEAGQIAGLNVLRIVNEPTAAALAYGLEKGEQEQTILVFDLGGGTFDVSLLEIGDGVVEVRATSGDNELGGDDWDQRIVDWLVEKFQSSNGIDLTKDKMALQRLREAAEKAKIELSSSQSANINLPYITVDADKNPLFLDETLSRAEFQRITQDLLARTKTPFNQVVKDAGVSVSEIDHVVLVGGSTRMPAVTELVKELTGGREPNKGVNPDEVVAVGAALQAGVLRGEVKDVLLLDVTPLSLGIETKGGVMTKLIERNTTIPTKRSETFTTAEDNQPSVQIQVFQGEREIATANKLLGSFELGGIAPAPRGVPQIEVTFDIDANGIVHVTAKDKGTGKENTITIQDGSGLSQDEIDRMIKDAEAHADEDKKRREEQEVRNNAESLVYQTRKFVEENSEKVSEDLKAKVEEAAKGVEEALKGEDLEAIKAAVEKLNTESQEMGKXIXEADAXAGATQADAGAEGAADDNVVDAEVVEDDAADNGEDKK

SEQ ID NO: 35 - DNA, 1947 bp, Corynebacterium glutamicum
  CDS (101)..(1924): RXN02280
cgcgattgcgtcatcgatcgttgttgcttccatgcgcaccacactatctttctgcacgccctgatgccctgtggattcaaaactgtgcttttataggcgtatgcaagaatcctcacgtgataatttccaagttgacctcggcggcgttgttgatcttttgagtcgccacatttattccggtccgagggtgtatgtgcgtgagttgctgcagaatgcggttgatgcttgtactgcacgttctgaacagggtgaggagggctacgagccgagtattcgtattcggccggtgaccaaggatcgtgccacgttttcactggttgataatggtacgggcctgaccgcgcaggaggcgcgggaattgctggcgacggtggggcggacgtcgaaacgcgatgaattcggtctgcagcgggaaggtcgcctggggcaatttggcatcgggctgcttagttgtttcatggtggcggatgagatcaccatggtgtcgcatgcggagggtgcgtcggcgattcggtggactggtcatgcggatggcacctttaacctggagattcttggggatgacgcaacggatgtcattccggtgggcacgactgtgcacctgactccgcgccctgatgagcgcacgttgctgacggaaaattccgtggtcaccattgctagtaattatggccgctacctgccgattcctattgtggtgcagggtgagaaaaacaccaccatcactacatcgccggtgtttgcaaaggatactgatcagcagcacaggctgtatgccggccgggagcgccttggtaaaactccttttgatgtcatcgatctcaccggtcctggcatcgagggtgtggcttatgtattgccggaggcccaggctccgcatatgtccaggcgtcacagtatttatgtcaaccgcatgttggtctctgatgggccttccacggtgctgcccaactgggcgttctttgtggaatgtgaaatcaattcaaccgatttggaacccaccgcatcgcgtgaagcgctcatggatgacaccgcgttcgcggcaaccagggaacatatcggtgagtgcattaaatcgtggctgattaatctcgccatgaccaagcctcaccgcgtgcgggaatttactgcgattcatgatcttgccctgcgcgagctgtgccaatcggacgcggacctggctgaaaccatgttgggtcttctcaccttggagacctcccgtggtcgcatctcgatcggtgagatcaccacgttgtccatcaccgaggatgtgtcgctgcagctggctaccacgttggatgatttcaggcagctcaacaccattgcgcgcccggacaccttgattattaatggcggctacattcacgacagcgatctggctcggctcattcccgttcactacccaccgcttacggtatctactgctgacctgcgcgaatccatggatctgatggagcttccgccgctgcaggacattgagaaagccaaggcactggatgcgcaggtcacggaatcattgaaggattttcagatcaagggcgcaacgagggtttttgaacccgcagatgttcctgccgtggtgatcattgattccaaggcgcaggcctcacgggatcgcaatgaaacacaaagcgcaaccactgatcgttgggctgacattttggcaacggtggataacacgttgagccgtcaaacagccaacattccacaggatcagggactgtcggcgttgtgcttgaattggaacaattcgctggtcaggaaattggcgtccactgatgacaccgccgtggtgtcgcgcacggtgcgtttgctctacgttcaggcattgttgtccagcaagaggccactgcgggtgaaggaacgcgcgctgcttaatgattcgctggcagatctggtttctttgtctttgtcatccgatatctaagacaatcctccgctaatctt

SEQ ID NO: 36 - protein, 608 aa, Corynebacterium glutamicum
MQESSRDNFQVDLGGVVDLLSRHIYSGPRVYVRELLQNAVDACTARSEQGEEGYEPSIRIRPVTKDRATFSLVDNGTGLTAQEARELLATVGRTSKRDEFGLQREGRLGQFGIGLLSCFMVADEITMVSHAEGASAIRWTGHADGTFNLEILGDDATDVIPVGTTVHLTPRPDERTLLTENSVVTIASNYGRYLPIPIVVQGEKNTTITTSPVFAKDTDQQHRLYAGRERLGKTPFDVIDLTGPGIEGVAYVLPEAQAPHMSRRHSIYVNRMLVSDGPSTVLPNWAFFVECEINSTDLEPTASREALMDDTAFAATREHIGECIKSWLINLAMTKPHRVREFTAIHDLALRELCQSDADLAETMLGLLTLETSRGRISIGEITTLSITEDVSLQLATTLDDFRQLNTIARPDTLIINGGYIHDSDLARLIPVHYPPLTVSTADLRESMDLMELPPLQDIEKAKALDAQVTESLKDFQIKGATRVFEPADVPAVVIIDSKAQASRDRNETQSATTDRWADILATVDNTLSRQTANIPQDQGLSALCLNWNNSLVRKLASTDDTAVVSRTVRLLYVQALLSSKRPLRVKERALLNDSLADLVSLSLSSDI

SEQ ID NO: 37 - DNA, 436 bp, Corynebacterium glutamicum
  CDS (101)..(436): FRXA02282
cgcgattgcgtcatcgatcgttgttgcttccatgcgcaccacactatctttctgcacgccctgatgccctgtggattcaaaactgtgcttttataggcgtatgcaagaatcctcacgtgataatttccaagttgacctcggcggcgttgttgatcttttgagtcgccacatttattccggtccgagggtgtatgtgcgtgagttgctgcagaatgcggttgatgcttgtactgcacgttctgaacagggtgaggagggctacgagccgagtattcgtattcggccggtgaccaaggatcgtgccacgttttcactggttgataatggtacgggcctgaccgcgcaggaggcgcgggaattgctggcgacggtggggcggacgtcgaaacgcgatgaattcggtctgcagcgggaaggtcgcctggggcaatttggc

SEQ ID NO: 38 - protein, 112 aa, Corynebacterium glutamicum
MQESSRDNFQVDLGGVVDLLSRHIYSGPRVYVRELLQNAVDACTARSEQGEEGYEPSIRIRPVTKDRATFSLVDNGTGLTAQEARELLATVGRTSKRDEFGLQREGRLGQFG

SEQ ID NO: 39 - DNA, 1269 bp, Corynebacterium glutamicum
  CDS (101)..(1246): RXA00886
taagtatgttggtcgtgtgctcgctggcgaatagctgcgggtatagttggccatttgttttgattaatctgtttagaagctaaaggaagtatcacccaccgtggcacgtgactattacggcattctcggcgtcgatcgcaatgcaaccgaatcagagatcaaaaaggcataccgaaagcttgcccgcaaataccacccggacgtaaacccaggtgaggaagcagcggagaaattccgcgaggcttctgttgcgcatgaggtactcactgatccggataagcgccgcattgttgatatgggcggtgacccaatggagcaaggcggcggagctggcgctggtggcttcggtggaggcttcggcggcagcggtggactgggcgatatcttcgatgccttcttcggcggtggcgcgggcggttcccgtggaccacgttcccgcgtgcagccaggcagtgacaccttgtggcgcacctccatcaccttggaagaggcttacaagggcgctaagaaagatctcacccttgacaccgcagtgctgtgtaccaagtgtcatggttctggatctgcatccgacaagaagcctgttacctgtggcacctgtaatggcgctggtgaaattcaggaagtgcagcgcagcttcctgggcaacgtcatgacgtcccgcccatgccacacctgcgatggcaccggtgagatcatcccagatccttgcactgagtgtgcagcagatggtcgtgtgcgtgctcgccgcgacatcgtggccaacatcccagctggcatccagtccggcatgcgcatccgcatggcaggccaaggtgaggttggcgctggtggcggtcctgcgggtgacctctacattgaagtcatggtgcgcccgcacgccatcttcacccgcgatggcgacgatctgcacgccagcatcaaggttccaatgttcgatgcagcgcttggcaccgaattggacgtggaatccctcaccggcgaagaggtgaaaattaccatccctgcaggtactcagcccaacgatgtgatcaccttggatggtgaaggcatgccgaagctgcgcgcagaaggccacggcaacctcatggcgcatgtcgatctatttgtgccaaccgatttggatgaccgcacccgcgaattgcttgaagaaatccgcaaccatcgcagcgacaacgcttccgtgcatcgcgaaggcggagaagaatccggtttctttgacaagctccgaaacaagttccgcaaataatgtcactgccagtatttatc

SEQ ID NO: 40 - protein, 382 aa, Corynebacterium glutamicum
VARDYYGILGVDRNATESEIKKAYRKLARKYHPDVNPGEEAAEKFREASVAHEVLTDPDKRRIVDMGGDPMEQGGGAGAGGFGGGFGGSGGLGDIFDAFFGGGAGGSRGPRSRVQPGSDTLWRTSITLEEAYKGAKKDLTLDTAVLCTKCHGSGSASDKKPVTCGTCNGAGEIQEVQRSFLGNVMTSRPCHTCDGTGEIIPDPCTECAADGRVRARRDIVANIPAGIQSGMRIRMAGQGEVGAGGGPAGDLYIEVMVRPHAIFTRDGDDLHASIKVPMFDAALGTELDVESLTGEEVKITIPAGTQPNDVITLDGEGMPKLRAEGHGNLMAHVDLFVPTDLDDRTRELLEEIRNHRSDNASVHREGGEESGFFDKLRNKFRK

SEQ ID NO: 41 - DNA, 1470 bp, Corynebacterium glutamicum
  CDS (101)..(1447): RXS00568
gtttcggacgacgcgagaaatcgcattaatcgtcggaaaccgggcttgtttttgtaatatctgaaactttccctttcccgatcatccaggagatttactcgtgaagagttctgtcgagaagctgagcgacacccgttcaaagatcaccgttgaggttccattttctgaactgaagccagagatcgaccaggcatacgccgctctagcgcagcaagtccagatccctggtttccgtaagggcaaggcaccgcgtcagcttatcgacgcacgcttcggccgtggtgcggttctggagcaggttgtcaacgacatgcttcctaaccgctacgcacaggcaatcgaagctgagggcatcaaggcaatcggccagcctaacgtagaggtcaccaagatcgaagacaacgagctcgttgagttcgtcgctgaggttgacgttcgcccagagttcgagcttcctaagttcgaggacatcactgttgaggtcccagctatcaaggctgacgaagaggcaatcgaagcagagctcgagaccctgcgtgcacgtttctccaccttgaaggatcacaaccacaagctgaagaagggtgagttcgtcaccatcaacatcaccgcaagcattgacggtgagaagattgaagaggcaaccactgagggtctgtcctacgaaatcggatctgacgatctgattgacggcctggacaaggctctgatcggcgctaagaaggatgaaaccgtagagttcacctctgagctggcaaacggcgagcacaagggcaaggaagctcaaatcagcgttgagatcaccgcaaccaagcagcgcgagctgcctgagctggatgatgagttcgcacagctggcttctgagttcgacaccatcgaagagcttcgtgagtccaccgtgtctgacgttgaggctaagcagaagaacgagcaggctgctgcaatccgcgacgaagttctcgctgcggctcttggcgaggctgacttcgctctgccacagtccatcgttgacgagcaggcacactcccagctgcaccagctcctcggcgagcttgcacacgacgatgctgcactgaactccctccttgaggctcagggcaccactcgtgaagagttcgacaagaagaacgtcgaagatgctgagaaggctgttcgcacccagctgttcctggacaccctctctgaggttgaggagcctgaggtttcccagcaggagctcaccgaccacatcctgttcaccgcacagtcttacggcatggacccaaaccagttcatcggtcagctgcagcagtccggccagatcgcgaacctcttctccgacgttcgccgtggcaaggctcttgcacaggctatctgccgcgtaaacgtgaaggactccgagggtaacgagatcgaccctaaggaatacttcggtgaagaagaagtagctgagactgagtctgaagcttaaaaactttaaagaaataacgc

SEQ ID NO: 42 - protein, 449 aa, Corynebacterium glutamicum
VKSSVEKLSDTRSKITVEVPFSELKPEIDQAYAALAQQVQIPGFRKGKAPRQLIDARFGRGAVLEQVVNDMLPNRYAQAIEAEGIKAIGQPNVEVTKIEDNELVEFVAEVDVRPEFELPKFEDITVEVPAIKADEEAIEAELETLRARFSTLKDHNHKLKKGEFVTINITASIDGEKIEEATTEGLSYEIGSDDLIDGLDKALIGAKKDETVEFTSELANGEHKGKEAQISVEITATKQRELPELDDEFAQLASEFDTIEELRESTVSDVEAKQKNEQAAAIRDEVLAAALGEADFALPQSIVDEQAHSQLHQLLGELAHDDAALNSLLEAQGTTREEFDKKNVEDAEKAVRTQLFLDTLSEVEEPEVSQQELTDHILFTAQSYGMDPNQFIGQLQQSGQIANLFSDVRRGKALAQAICRVNVKDSEGNEIDPKEYFGEEEVAETESEA

SEQ ID NO: 43 - DNA, 826 bp, Corynebacterium glutamicum
  CDS (101)..(826): RXN03038
gcgcggaaaacaccaagtaagccttacagtccgacagcctcatagcggatgggataagttccaaacacgttcaaatccgttaaagtgcctgtttaaaactatgcattcaaaggaagagttaacagtgcgtaaaggaatttcccgcgtcctctcggtagcggttgctagttcaatcggattcggaactgtactgacaggcaccggcatcgcagcagctcaagactctgcatttgactacggtatggatccaaacatgaactacaacccgatcgatgacatcaaggatcgtcccgaaggattgtccaatcttccctacttcggaagtaaattgaccagctggggctcatcatatgccaccgcctcatccggcgtcgtgacctccgcgctcccgcagtacaccgatccgcgctaccccctcggcaaagacgacctgcccaaggcaaccatcgacatggagccagaagttcttgcgcgccttgagcgattcgtcggcgttgacggtgatcgcatccgccaaatcaacgcgtactcgccatcaatgggacgcaccattcctctagtctgggttgttccagaagacaacaccgtgcctggcccaacggtctacgcactcggaggcggtgacggtggacaaggcggccagaactgggtcacccgcaccgaccttgaggaattaaccagtgacaacaacatcaacctcatcatgccgatgctcggatcttttagtttctactctgactgggcacgcgaaagccaatccatgggttgtgcgcaacagtgggaaacattgctcatgcacgaactgcctgagccgcttgtagcggcc

SEQ ID NO: 44 - protein, 242 aa, Corynebacterium glutamicum
MHSKEELTVRKGISRVLSVAVASSIGFGTVLTGTGIAAAQDSAFDYGMDPNMNYNPIDDIKDRPEGLSNLPYFGSKLTSWGSSYATASSGVVTSALPQYTDPRYPLGKDDLPKATIDMEPEVLARLERFVGVDGDRIRQINAYSPSMGRTIPLVWVVPEDNTVPGPTVYALGGGDGGQGGQNWVTRTDLEELTSDNNINLIMPMLGSFSFYSDWARESQSMGCAQQWETLLMHELPEPLVAA

SEQ ID NO: 45 - DNA, 653 bp, Corynebacterium glutamicum
  CDS (1)..(630): RXN03039; All occurrences of Xaa indicate any amino acid
gcactcccgcaatacaccgacccacgctaccccctcggcaaagacgacctgcccaaagcaaccatcgacatggagccagaagctcttgcgcgccttgagcgattcgtcggcgttgacggtgatcgcatccgccaaatcaacgcgtactcgccatcaatgggacgcaccattcctctagtctgggtcgtgccagaagacaacaccgtgcctggcccaacggtctacgcactcggcggcggcgacggtggccaaggcggccaaaactgggtcacccgcaccgaccttgatgagttgaccagtgaaaacaacatcaacctcatcatgcccatgctcggatcttttagtttctacgctgactgggcaggcgaaagcgaatccatgggtggtgcgcaacagtgggaaacattcctcatgcacgaactrccmgagccgctagaagcggccatcggcgcagacgggcaacgcagcatcgtcggcatgtccatgtccgggggatcrgtgctgaactttgcgacgcatgaccccaacttttaytcctckgtcggctcattttctggatgtgccgaaaccaactcctggatgggrcgccgntggcatcgcagccactgcctacaacggcaatgtcgtgcctgagcaaatctttggtgaagtag

SEQ ID NO: 46 - protein, 210 aa, Corynebacterium glutamicum
  All occurrences of Xaa indicate any amino acid
ALPQYTDPRYPLGKDDLPKATIDMEPEALARLERFVGVDGDRIRQINAYSPSMGRTIPLVWVVPEDNTVPGPTVYALGGGDGGQGGQNWVTRTDLDELTSENNINLIMPMLGSFSFYADWAGESESMGGAQQWETFLMHEXXEPLEAAIGADGQRSIVGMSMSGGXVLNFATHDPNFXSXVGSFSGCAETNSWMXRRWHRSHCLQRQCRA

SEQ ID NO: 47 - DNA, 432 bp, Corynebacterium glutamicum
  CDS (101)..(409): RXN03040; All occurrences of n indicate any nucleotide; All occurrences of Xaa indicate any amino acid
attactctcgctataacgatccttntgctcaacgctgcgaagctcgaagaacaagacaacctctacatcttcgccggttccggtgtgttctctgaactagatgtcatncggtgacaacgcaccgattgatgaggatgcgttcaaaaaccgcgtcttggttgggtttgaaatcgaagctatgtccaacacctgcacccataacctcaaggctgcgaccgatcaaatgggcatcgacaacatcaactacgatttccgaccaaccggaacccacgcctgggattactggaacgaagcgctccaccgcttcttcccgttgatgatgcagggcttcggcctcgacggtggtcccatcccgatctataaccctaacggtgtgacctccagcgagtcttctntcagaactgtcttctgatgtgagccttggcaccngtg

SEQ ID NO: 48 - protein, 103 aa, Corynebacterium glutamicum
  All occurrences of Xaa indicate any amino acid
MSXGDNAPIDEDAFKNRVLVGFEIEAMSNTCTHNLKAATDQMGIDNINYDFRPTGTHAWDYWNEALHRFFPLMMQGFGLDGGPIPIYNPNGVTSSESSXRTVF

SEQ ID NO: 49 - DNA, 835 bp, Corynebacterium glutamicum
  CDS (101)..(835): RXN03051
acatccagaagtagtcgttgagtatcacgagcaagtcaacgatagtaaagataatgtcgaggaactcccgctgcctaagcgggacatagttgcaggggacatgcgttcagatgttatcgagttaccggagggggtaagcaaggagaaagctgaccagctagaagttgcggaagcgcgacttaacgagggtgcacgactgatggcaaccaccgggtgtgaggttatgtggccaacgggcttctcagtttgtggccgaattcttgacacctatcgccaggttggaggtcagttgtcatggcttgggccaccgaagtcaaacgagttgaccaatcccgacggtgttggcaaaagaagtgaattttttggtggagccatctattggcacccagacacaggcgcttatgcagtgaccttggacggtttgcgacagtgggggaccttgaactgggaatcagggccattggggtacccaacctctggtccgatggatacaaactatccccttactcagcgacagacttttcaaggtggtgacaactactacaacccattgactggcggtgctgtgtggggcgatattaaacagcgctacgaagaacttggcggctcgaatcatgccattggcatcccgatcactaatgagctacctagcggtactgagtatttttacaataatttctccaatggaacaatttcgtggcgaaatgatcgtcagacacggtttatgtatttggctacgcagcgggtgtgggatgcgttgggtcgggagacgggtcgtttaggttttcctgaagcagatgaaacacctgaggtttctggtctattccatgtggcg

SEQ ID NO: 50 - protein, 245 aa, Corynebacterium glutamicum
MRSDVIELPEGVSKEKADQLEVAEARLNEGARLMATTGCEVMWPTGFSVCGRILDTYRQVGGQLSWLGPPKSNELTNPDGVGKRSEFFGGAIYWHPDTGAYAVTLDGLRQWGTLNWESGPLGYPTSGPMDTNYPLTQRQTFQGGDNYYNPLTGGAVWGDIKQRYEELGGSNHAIGIPITNELPSGTEYFYNNFSNGTISWRNDRQTRFMYLATQRVWDALGRETGRLGFPEADETPEVSGLFHVA

SEQ ID NO: 51 - DNA, 1704 bp, Corynebacterium glutamicum
  CDS (101)..(1681): RXN03054
ggtggaaatacgcgcacaacaattttattcacagaacttatgattttttcgggttagggtcagtttgttcacatcaactagtaacgaaaggatcatgtgaatgaaactgttttccaaggctgcaggcgtcattgctgcagcacttcttgttgcaggtggtatagcacctgtggcacaggggcaagctagtcaggtggtcacacctgaagaccaagatgcgtatgttcaacagttccaccacgaagggaataccccacctgtggtagacggggtgggtggctacactgagcaagaaatcgccgagatccacgaggctatccgacaagcccaagaatctggcgcacctaatgaagagctcattccgggtgagatgtggtcagataaggtggagctgccagtaactattgataaagcagccgctgatgaggcagagatagctattgcacagcaacaatctcagccacagacgcgaggccttgctgcggctgcggcgtgtcagacgttttggccgtcacctcatcaggtttgtggtgctattttagagcgctatattcagcagggtgcccagtttgggtggatgttgtttccgagtgaaggccaaacgttaaatcctgatggtcaggggtatcgtcagcggtttatgaatgggtttgtttattggcatccgacaactggtgcgcatgctgttaataattacagtgcgcaggtgtgggagcgtaatgggtgggagtctgggtggatgggttatcccactggtggtgaagtccctgtgaatggttccaatccgattgatggtgagttgagtgggtgggtgcaaactttccaaggtgggcgagtgtatcgcagtccggtattggacggtttccaggtggccagtattaatgggctgatcttggataaatggcttgaattgggtggtcctgatagtgaccttggttttcccattgcggatgaggctgtgacagctgacggtgtgggtagattttctgttttccagaacggagttgtctactggcatccgcaacacggagctcaccctatattagggaatatatacagtatctggagagaagaaggagctgagagtggggaattcggttaccctatcggcgatccagaaaagtatacagaaaacatggctaatcaggtattcgaaaaaggcgaacttgcagctaacctataccccaatcctcttgaggcttttattgagtttttaccctttgctaatcttgaggaagcaatagagtattttgagaacggattgtcaaattctcgtgtagaggcgaattcacttaacgccaagaaagattcgattcaatgtcaatcgcaatccgctaacattcatgtgagaacgaagagtgacggagtcgggattagggttccaaagattgggtttaaggctaggatggattgcgaccttcctggaactgtctcagatgtagtggggtatggatggatttactacgactattggggacgatgggctcaagcagcatatgcacaacaattcttcggtaataggaattctgttgtgcaaaccaatttagaggcgggttgcagcggggagaagaatacattattttggggtacttcatattttcaggtgacttatgaaggtcagccgtatttcggtcagtcagcaactaattacgcttatcttccgtgtacgatagaccgtagttaacataaggaatggaataggag

SEQ ID NO: 52 - protein, 527 aa, Corynebacterium glutamicum
MKLFSKAAGVIAAALLVAGGIAPVAQGQASQVVTPEDQDAYVQQFHHEGNTPPVVDGVGGYTEQEIAEIHEAIRQAQESGAPNEELIPGEMWSDKVELPVTIDKAAADEAEIAIAQQQSQPQTRGLAAAAACQTFWPSPHQVCGAILERYIQQGAQFGWMLFPSEGQTLNPDGQGYRQRFMNGFVYWHPTTGAHAVNNYSAQVWERNGWESGWMGYPTGGEVPVNGSNPIDGELSGWVQTFQGGRVYRSPVLDGFQVASINGLILDKWLELGGPDSDLGFPIADEAVTADGVGRFSVFQNGVVYWHPQHGAHPILGNIYSIWREEGAESGEFGYPIGDPEKYTENMANQVFEKGELAANLYPNPLEAFIEFLPFANLEEAIEYFENGLSNSRVEANSLNAKKDSIQCQSQSANIHVRTKSDGVGIRVPKIGFKARMDCDLPGTVSDVVGYGWIYYDYWGRWAQAAYAQQFFGNRNSVVQTNLEAGCSGEKNTLFWGTSYFQVTYEGQPYFGQSATNYAYLPCTIDRS

SEQ ID NO: 53 - DNA, 456 bp, Corynebacterium glutamicum
  CDS (101)..(433): RXN02949
actctcgaaggttgaacacagggctgcgattgtgctggatcaaatgtctgcacgaaaaattgttatcgcccctggatgagtagtgatttagaggagtgctgtgagcgacgagcagaattctggcgtaggcggaacgtctcgcccaacgggtaaacgccagctgtcgggtgcttccactacctctacctcttcttatgaggctaagcaggtatctacacagaagaagtcatccggttcggattctaagcctggcggcggtgttatttcttttctgcctgaggttgtgggagaagtccgtaaggttatttggcctactgcgcgccagatggtcacgtacacccttgtcgttttgggattcttgattgttttgaccgctttggtgtctggtgtggatttcctagctggtcttggagttgagaagattctgactccgtaggtaggatgtgtaacatcttt

SEQ ID NO: 54 - protein, 111 aa, Corynebacterium glutamicum
VSDEQNSGVGGTSRPTGKRQLSGASTTSTSSYEAKQVSTQKKSSGSDSKPGGGVISFLPEVVGEVRKVIWPTARQMVTYTLVVLGFLIVLTALVSGVDFLAGLGVEKILTP

SEQ ID NO: 55 - DNA, 1941 bp, Corynebacterium glutamicum
  CDS (101)..(1918): RXN02462
tccatcctcatcgacgaagcccgcaccccactgattatctccgggaccagtagacggcacatcgcagttctacaacgtcttcgcacagatcgtcccacgcatgaccaaggacgttcactacgaagtcgacgaacgtaaaaagaccgtcggtgtgaaagaagaaggcgtcgaatacgtcgaagaccaactcggcatcgacaacctctacgcacctgagcactcacagctggtcagctacctgaacaacgccatcaaggcacaggaactgttcacccgcgacaaggactacatcgtccgcaacggcgaagttatgatcgtcgacggcttcaccggccgtgtccttgccggccgccgatacaacgaaggcatgcaccaggcgatcgaagccaaagagcgcgtagagatcaaaaacgagaaccagaccctggcgaccgttaccctccagaactacttccgcctctacaccaaactcgccggcatgaccggtaccgcagagaccgaagcagcagagctcaaccagatctacaagctcgacgtcatcgcgatcccaaccaaccgaccaaaccagcgcgaagacttgaccgacttggtgtacaaaacccaagaggctaagttcgcagcagtcgtcgacgacatcgcagaacgcaccgaaaagggccaaccagtcctcgtcggtaccgtctccgtcgagcgctccgaatacctctcccagctgttgaccaaacgaggcatcaagcacaacgtcctcaatgcgaagcaccacgagcaggaagcacagatcgttgctcaggcaggtcttccaggcgccgtcaccgttgccaccaacatggcgggccgtggaaccgacatcgtgctcggcggaaacccagaaatcctcctcgacatcaaactccgcgaacgtggacttgatcctttcgaagacgaagaaagctaccaggaagcctgggacgctgaacttccagcaatgaagcagcgatgcgaagaacgtggcgacaaagtccgcgaagccggaggactctacgtccttggcaccgaacgccacgaatcccgacgcatcgacaaccagctgcgcggtcgttctgcacgtcagggcgacccaggatccacccgcttctatctctctatgcgcgacgacctgatggttcgcttcgtcggcccaaccatggaaaacatgatgaacaggctcaacgtcccagacgatgtgcccatcgaatccaaaaccgtcaccaactccatcaagggcgcccaagctcaggtggagaaccagaacttcgaaatgcgtaagaacgttctgaagtacgacgaagtcatgaacgaacagcgcaaggttatctacagcgagcgacgcgaaatcctcgaatccgcagacatctcccgctacatccaaaacatgatcgaagaaacagtcagcgcatacgtcgacggcgccaccgccaacggctacgtcgaagactgggacctcgacaaactctggaacgccctcgaagccctctacgacccatcgatcaactggaccgacctcgtcgaaggcagcgaatacggcaaaccaggggagctgtccgccgaagatctacgcaccgcactcgtcaacgacgcccacgccgaatacgcaaaactcgaagaagccgtatccgcaatcggcggcgaagcacagatccgcaacatcgaacgaatggtgctcatgccagtcatcgacaccaaatggcgcgaacacctctacgaaatggactacctgaaagaaggcatcggcctgcgcgcaatggcacagcgcgacccactggtcgaataccaaaaggaaggcggcgacatgttcaacggcatgaaagacggcatcaaggaagaaaccgtccgccagctcttcctctccgcaagcagttcatcaagcaagacgcggaagtcgctgactaactcagaaccctgaaattcagcatccgccacatg

SEQ ID NO: 56 - protein, 606 aa, Corynebacterium glutamicum
MTKDVHYEVDERKKTVGVKEEGVEYVEDQLGIDNLYAPEHSQLVSYLNNAIKAQELFTRDKDYIVRNGEVMIVDGFTGRVLAGRRYNEGMHQAIEAKERVEIKNENQTLATVTLQNYFRLYTKLAGMTGTAETEAAELNQIYKLDVIAIPTNRPNQREDLTDLVYKTQEAKFAAVVDDIAERTEKGQPVLVGTVSVERSEYLSQLLTKRGIKHNVLNAKHHEQEAQIVAQAGLPGAVTVATNMAGRGTDIVLGGNPEILLDIKLRERGLDPFEDEESYQEAWDAELPAMKQRCEERGDKVREAGGLYVLGTERHESRRIDNQLRGRSARQGDPGSTRFYLSMRDDLMVRFVGPTMENMMNRLNVPDDVPIESKTVTNSIKGAQAQVENQNFEMRKNVLKYDEVMNEQRKVIYSERREILESADISRYIQNMIEETVSAYVDGATANGYVEDWDLDKLWNALEALYDPSINWTDLVEGSEYGKPGELSAEDLRTALVNDAHAEYAKLEEAVSAIGGEAQIRNIERMVLMPVIDTKWREHLYEMDYLKEGIGLRAMAQRDPLVEYQKEGGDMFNGMKDGIKEETVRQLFLSASSSSSKTRKSLTNSEP

SEQ ID NO: 57 - DNA, 1965 bp, Corynebacterium glutamicum
  CDS (101)..(1942): RXN01559
gtctggttgattggaattgaaggagactttcttggctcggcaaaaaaagagtgccgctagcgcctgggaacgatggccaaaacgcgcaatagcgttgtttgtgctcatcgtcgttggtgtttatgcgttggtgctgttgacaggcgatcgttctgccacaccaaaattgggtattgatctgcaaggcggaacccgagtgaccctcgtgccgcaggggcaggatccaactcaggaccagctgaatcaggcacgcaccattctggaaaaccgtgtgaacggcatgggcgtttcaggtgcaagcgtggtcgctgacggtaacacgctggtgatcactgttcccggggaaaataccgcacaggcgcaatccctaggacagacctcccagctgctgttccgtcccgttggtcaggcaggaatgcccgatatgaccacgttgatgccagagctggaagagatggccaacaggtgggttgaatacggcgtcatcaccgaagagcaggcaaatgcctccttggaggaaatgaacaccgctgttgcatcgaccactgcggtggaaggcgaagaagcaactgagccagaacccgtcaccgtgtcggcgacccctatggatgagccagccaactccattgaggcaacacagcgacgccaggaaatcacggacatgctgcgcaccgaccgccagtccaccgatcccactgtccagatcgctgcaagttctttgatgcagtgcaccactgatgagatggatcctttggccggcaccgatgatccacgcctgccattggtggcatgtgatccagctgtaggtggcgtgtatgtacttgatcctgcacctttgctcaacggcgaaaccgatgaggaaaatggtgcgcgcctaaccggtaatgagatcgataccaaccgtcccatcaccggtggattcaacgcccagtccggccagatggaaatcagctttgccttcaaatccggcgatggggaagaaggctctgcaacttggtcctctctgaccagccagtacctgcagcagcagatcgccatcaccctggactctcaggtgatttctgcacccgtgattcagtcagcaacccctgtgggttctgcaacatccatcaccggtgacttcactcaaactgaagcccaagatctggcgaacaacctgcgctacggtgcattgcccctgagcttcgcaggtgaaaacggcgagcgcggcggaactaccaccaccgttccgccatcactaggcgcagcatccttgaaggccggactgatcgcaggcatcgtcggcatcgcgctggtcgccatcttcgtgttcgcctactaccgcgtcttcggattcgtttccctgttcaccctgtttgccgcaggcgtgttggtctacggccttctggtactgctgggacgctggatcggatattccctagaccttgctggtatcgccggtttgatcatcggtatcggtaccaccgccgactccttcgtggtgttctatgagcgcatcaaggatgagatccgtgaaggaagatcctttagatctgcagtacctcgtgcatgggaaagcgccaagcgcaccatcgtcacaggcaacatggtcactttgctcggcgctatcgtgatttacttgctcgcggtcggcgaagtcaagggctttgccttcaccctgggtctgaccaccgtattcgatctcgttgtcaccttcctgatcacggcaccactggttatcctggcatcacgcaacccattctttgccaagtcatcggtcaacggcatgggacgagtgatgaagctcgttgaagaacgccgcgccaacggtgaattggatgagcctgagtacctgaaaaagatccatgccaagaatgcggcagctgataaggcttccactgacaattcttccactgacaattctgaagcacctggcaccgatacgaaccaagaggaggagaagtagccatgactgattcccagact

SEQ ID NO: 58 - protein, 614 aa, Corynebacterium glutamicum
VLIVVGVYALVLLTGDRSATPKLGIDLQGGTRVTLVPQGQDPTQDQLNQARTILENRVNGMGVSGASVVADGNTLVITVPGENTAQAQSLGQTSQLLFRPVGQAGMPDMTTLMPELEEMANRWVEYGVITEEQANASLEEMNTAVASTTAVEGEEATEPEPVTVSATPMDEPANSIEATQRRQEITDMLRTDRQSTDPTVQIAASSLMQCTTDEMDPLAGTDDPRLPLVACDPAVGGVYVLDPAPLLNGETDEENGARLTGNEIDTNRPITGGFNAQSGQMEISFAFKSGDGEEGSATWSSLTSQYLQQQIAITLDSQVISAPVIQSATPVGSATSITGDFTQTEAQDLANNLRYGALPLSFAGENGERGGTTTTVPPSLGAASLKAGLIAGIVGIALVAIFVFAYYRVFGFVSLFTLFAAGVLVYGLLVLLGRWIGYSLDLAGIAGLIIGIGTTADSFVVFYERIKDEIREGRSFRSAVPRAWESAKRTIVTGNMVTLLGAIVIYLLAVGEVKGFAFTLGLTTVFDLVVTFLITAPLVILASRNPFFAKSSVNGMGRVMKLVEERRANGELDEPEYLKKIHAKNAAADKASTDNSSTDNSEAPGTDTNQEEEK

SEQ ID NO: 59 - DNA, 819 bp, Corynebacterium glutamicum
  CDS (101)..(796): RXN00046
tggtgcccaagcagccgtcatcgcagcagcaaaatatgcccgcgataacgccttttaagcacctaaaacgctgttctcaacacaggagtttccttaaataatggacttaaatactcaacgctcaaagctctacgcacagcttcaaggccagctcattgtttccgtgcaagctcccgacggccatgccatgcgagatacccatacgctcacccatgtggccgcagcctgtgtcgatggcggtgctcctgccattcgctgtggcggttacggcggtttggaagatatccgttcaatctccaaccgtgtcgacgttcccgttttcggactcaccaaagaaggctccgaaggagtttacatcaccccaaccagggattccgttcgagcagtggcagaatccggcgccactgtagtctgcgcggatgcaactttccgacctaggcctgacggctccacctttgcagagctggtcactgttgcccacgattccggaattctcatcatggcggactgcgcaactcccgaagaagttctcagtgcgcataaggctggcgcggattttgtgtccaccacgcttgctggatacaccgaacaccgcgagaaaacagtcggtccagatttcgattgcctccgcgaagcacgtgagttagttcccgatgcgttcctcattggcgaaggtcgcttctccaaccctgcggatgtggcgcacggtcgtctcattggtgccaacgcgatcatcgtgggcaccgcaatcactgaccctggtttcatcactggacagttcgcgtcactgttgcactagcacttagtccagcgctgcac

SEQ ID NO: 60 - protein, 232 aa, Corynebacterium glutamicum
MDLNTQRSKLYAQLQGQLIVSVQAPDGHAMRDTHTLTHVAAACVDGGAPAIRCGGYGGLEDIRSISNRVDVPVFGLTKEGSEGVYITPTRDSVRAVAESGATVVCADATFRPRPDGSTFAELVTVAHDSGILIMADCATPEEVLSAHKAGADFVSTTLAGYTEHREKTVGPDFDCLREARELVPDAFLIGEGRFSNPADVAHGRLIGANAIIVGTAITDPGFITGQFASLLH

SEQ ID NO: 61 - DNA, 1219 bp, Corynebacterium glutamicum
  CDS (48)..(1196): RXN01863
ggtatcataccgatatgaaccaaatagaaagaaggaagtttaagacgatgaatagcgtcaaattgaagcaacctgttagcatttacaatgatccatgggaatcatataacgatgttaaagaacatggccaattaactttaagtaacatcgaatttacaactacaaatctttgtaatatgcgttgtagccactgtgcagttggttatactttacaaactgtcgaccccgagcctttagatatggacttaatttatcgtagacttgatgaaattccaaatctgcgaacgatgtcaattacaggtggcgaaccaatgttttctaaaaagtctattagaaatgttgttaaacctctattaaagtatgcacatcatcgaggtatatatacacaaatgaattcaaacctaacattgcctcaagatcgttatttagatattgctgaatatatcgatgttatgcatatctcacataactggggaacaactgatgaattcgcaaatgttggctttggcgcaatgaagaagcaaccaccgttaaaagctaagttaaaattatatgaacaaatgatttcgaatgcacgtacattatcagaacaaggaatgtttgtatctgcggaaacaatgctcaatcaaagtacgctaccacatttacgaaaaatacatcaagaagtcgttcatgatatgaaatgtagcagacacgagattcaccctatgtatccagctgactttgcaagtcaattaaatgtgttaactctagcggaaatgaaaaagacaattcatgatatattggatttcagagatgaagatatttggatgttatttggtactttgcctgtgtttccatgcttaaaggatgatgaagatcaaaagttactatcacgtttaagaaatgctaacaatgtaacgactagaaatgacccggatggccgtagtcgtttaaatgtcaatgtatttacaggtaatgtaatcgtaactgatttcggagatgaaacaggtacaatttcgaatatacaaaaagataaattaacagatgtatttgataaatggttatcctctgatcttgctaaatcattaaattgtcattgttccgagtttagttgtttaggaccaaatgttcttgttaaaaatatgtactatccgaatatggattttaaagataatgagcgtcatatgcacaaacaaccacaaattatacaattttaaaaactcttaattatgcggag

SEQ ID NO: 62 - protein, 383 aa, Corynebacterium glutamicum
MNSVKLKQPVSIYNDPWESYNDVKEHGQLTLSNIEFTTTNLCNMRCSHCAVGYTLQTVDPEPLDMDLIYRRLDEIPNLRTMSITGGEPMFSKKSIRNVVKPLLKYAHHRGIYTQMNSNLTLPQDRYLDIAEYIDVMHISHNWGTTDEFANVGFGAMKKQPPLKAKLKLYEQMISNARTLSEQGMFVSAETMLNQSTLPHLRKIHQEVVHDMKCSRHEIHPMYPADFASQLNVLTLAEMKKTIHDILDFRDEDIWMLFGTLPVFPCLKDDEDQKLLSRLRNANNVTTRNDPDGRSRLNVNVFTGNVIVTDFGDETGTISNIQKDKLTDVFDKWLSSDLAKSLNCHCSEFSCLGPNVLVKNMYYPNMDFKDNERHMHKQPQIIQF

SEQ ID NO: 63 - DNA, 618 bp, Corynebacterium glutamicum
  CDS (101)..(595): RXN00833
agctttttgcatgtgtcatatcgtaccgtttgcataggcctgttcgcgcttggtgaaccttttctagcaccaaaacaaaactctccctagtatggggtccatggctaaaacacattttcaaggcaacgaaactgctacctccggcgaactgccacaggtcggcgacaacctcgcagagttcaacctcgtcaacaccgaactgggcgaggtctcctcaaaggacttccagggccgcaagcttgtcctgaacatcttcccatccgttgacaccggcgtttgtgcaacatcagtccgcaagttcaacgaggcagcagcaagcctggaaaacaccaccgtgctgtgcatctccaaggatcttccattcgcactgggccgtttctgctccgcagaaggcatcgagaacgtcaccccagtatccgcattccgttccaccttcggtgaagacaacggcatcgtgctcgaaggctcaccacttaagggtcttcttgcacgcagcgtcatcgtcgtcgatgaaaacggcaaggttgcttacacccagttggttgatgagatcttcactgaacctgattacgacgctgcacttgctgggctgaactaatttacttcgctcaggggaat

SEQ ID NO: 64 - protein, 165 aa, Corynebacterium glutamicum
MAKTHFQGNETATSGELPQVGDNLAEFNLVNTELGEVSSKDFQGRKLVLNIFPSVDTGVCATSVRKFNEAAASLENTTVLCISKDLPFALGRFCSAEGIENVTPVSAFRSTFGEDNGIVLEGSPLKGLLARSVIVVDENGKVAYTQLVDEIFTEPDYDAALAGLN

SEQ ID NO: 65 - DNA, 879 bp, Corynebacterium glutamicum
  CDS (101)..(856): RXN01676
agttacagcttttctcggtggcacactcgcgctacttagcccttgtgccgcactccttttaccagcattttttgcatcctcagtgggtgctggcccgcgcatgatccttcacggtgttgtgttctacgcaggacttctagtacttctcgtgccacttggccttggtgcgggaatcctcggcgagctgtttatcacccaacgccagaccatcatcgtggtttcatcgatcgtgctgattatcctaggttttgtccagatcttcggcggcggattcgacttcggaaaagcactcccaggattagatcgtctgcaatctaaggccactgtgacctcaggtctaggaaagagctttttactaggaatgaccagtagtattgccggtttttgttccggaccaatcctcggcgccgttcttactttggctgccaccagtggaaactccatcacctcagcactcattttgagtgcttatggtgcgggaatggtgctgcccctgatggctattgcagcgctctgggccaaactcggacagcgtggacagcagatgctccgcggccgggaattcaccttcttgggcaggcagtggcacattgtttctgtcattagcggtgccctgatcatcgctgtcggaatcctcttttggtccacgaacggccttgtcagcatgccggagctcgttccaatggacacccagatctggctacaggaagccacattctcactcgggtcaccactctttgacatcgcattgatcattgtcgccgctggcttgttcttgtacttctggaacaaacgacaaaagcgaaaagaagaagctcagcgacccaaagaaagtggatgggttattaaccctcgctaattattagttttggagcgagg

SEQ ID NO: 66 - protein, 252 aa, Corynebacterium glutamicum
MILHGVVFYAGLLVLLVPLGLGAGILGELFITQRQTIIVVSSIVLIILGFVQIFGGGFDFGKALPGLDRLQSKATVTSGLGKSFLLGMTSSIAGFCSGPILGAVLTLAATSGNSITSALILSAYGAGMVLPLMAIAALWAKLGQRGQQMLRGREFTFLGRQWHIVSVISGALIIAVGILFWSTNGLVSMPELVPMDTQIWLQEATFSLGSPLFDIALIIVAAGLFLYFWNKRQKRKEEAQRPKESGWVINPR

SEQ ID NO: 67 - DNA, 744 bp, Corynebacterium glutamicum
  CDS (101)..(721): RXN00380
caggcaatgcgacctcgcctcagtgacatccttggtgttccaagacgatcaaattgtcggcgtgcattacaacgaaccagctcaggagatttgatcactcgtgcgtttgaccaaactagcagcaacaatcggctgcgtgacactcagcggacttgcgctagtagcctgcagcagtgacagtaccgctggtactgacgctgttgctgtcggcggaaccttccaattccactccccggatggaaagatggaaattttctacgacgaggctgaccgtcaacaactccccgacattggtggagattccctcatggaagagggcacacagatcaacctgtctgatttcgaaaaccaagttgtcatcctcaatgcgtgggggcagtggtgtgcaccgtgccgctccgaatccgatgatctccagattatccatgaggaactccaagctgccggaaacggcgacacccctggtggcaccgtgttgggtatcaatgtgcgtgattactcccgcgacatcgcccaagactttgtcaccgacaacggccttgattacccaagcatttacgatccaccatttatgacagcagcatccctcggtggtgttcccgcatcggtgatcccaaccaccatcgtgctggataaacagcaccgccccgcagcagtgttcttgcgcgaagtcacctccaaagatgtgttggatgttgcgttgccattggtagatgaggcctaaatgtctgagattgtggtagc

SEQ ID NO: 68 - protein, 207 aa, Corynebacterium glutamicum
VRLTKLAATIGCVTLSGLALVACSSDSTAGTDAVAVGGTFQFHSPDGKMEIFYDEADRQQLPDIGGDSLMEEGTQINLSDFENQVVILNAWGQWCAPCRSESDDLQIIHEELQAAGNGDTPGGTVLGINVRDYSRDIAQDFVTDNGLDYPSIYDPPFMTAASLGGVPASVIPTTIVLDKQHRPAAVFLREVTSKDVLDVALPLVDEA

SEQ ID NO: 69 - DNA, 495 bp, Corynebacterium glutamicum
  CDS (101)..(472): RXN00937
agctgccggtcaatgaagaaaatccttggccgggaataactacagtccgctgaaagttggtctatatatagaccttacaaatcttgaacggagattcttaatggcaaccatcgatgtaaccgaagaaacatttgagagcacagttaccggcgacggaattgtcctcgtagacgcatgggcatcctggtgcggaccttgccgccagttcgccccaacctacgagaaggtttccgaaacccacaccgacgcaaccttcgccaagcttgataccgaagcaaaccagggcctggctgcagcactgcagatccagtccatcccaactctgatggttttccgcgacggcatcatggtctaccgcgaagccggcaccatgccagctcctgcactggatgatctggtcaaccaggttaaggcactcgacatggatgacgttcgtcgccaggtcgcagagcagcagggttctgcagaggcataagcttccaattgtgttttggt

SEQ ID NO: 70 - protein, 124 aa, Corynebacterium glutamicum
MATIDVTEETFESTVTGDGIVLVDAWASWCGPCRQFAPTYEKVSETHTDATFAKLDTEANQGLAAALQIQSIPTLMVFRDGIMVYREAGTMPAPALDDLVNQVKALDMDDVRRQVAEQQGSAEA

SEQ ID NO: 71 - DNA, 990 bp, Corynebacterium glutamicum
  CDS (101)..(967): RXN02325
cagagatttgaagatggagaccaaggctcaaagggaatccatgccgtcttggtttaatactgcacccgtctaatgaaaatcattactattaggtgtcatgatggaccatgcacacgattcctgctcaccaactctgcgccgtgatttggaggtcactggccagctccaacctgagaaagctgtcgatttagcagcgccgcacgaagggaaggttgccaatataacgaaggtgacctcctcaaatatggagcacaccatcacgcaggcctcaaaagctaaggaggtggtggtgctcattggtcactccctgctgcccacatttcaggatttggaaaaagacattctgcactttcaggcaggtaataaagggcgattttctgtagcgattgttgatcctgatcgcagtgcagatgtggttgccagatttaggccaaaacagattccggtggcatacgtggtgaaagatggcgccagcattgcggagttcaactcgctcaacaaggagccggttgcacaatggcttgatcattttgtgtcgcgggaaacgatccccaatgaaaaagagggggacgtcgataagcaaatagacccgcgcctgtggcgggcagcggaattggtgaacgccggtgattttcgcgcggcgttggcgttgtatgagcagttgccgcaggatgcgacggtgaagcgggcgcacgcggcggtgtcggtattggcgcggatgtctgtggcggatcggggagaggatccgatcgagaagtcgcgccgggatccagacgatgtgaacaaggcgctggcggcggcggatatgtatgtgttgatgaatcagccggacacagcgctcgcgcaccttgcagcactattgccaaaaccggaggctgcccggcggatcgtggagttgctgaacttgtttgatccgctggacctggtcgcattggaaatcagggcgcaggtggggaatgcaatgagctaagaaaacactttaaatattct

SEQ ID NO: 72 - protein, 289 aa, Corynebacterium glutamicum
MDHAHDSCSPTLRRDLEVTGQLQPEKAVDLAAPHEGKVANITKVTSSNMEHTITQASKAKEVVVLIGHSLLPTFQDLEKDILHFQAGNKGRFSVAIVDPDRSADVVARFRPKQIPVAYVVKDGASIAEFNSLNKEPVAQWLDHFVSRETIPNEKEGDVDKQIDPRLWRAAELVNAGDFRAALALYEQLPQDATVKRAHAAVSVLARMSVADRGEDPIEKSRRDPDDVNKALAAADMYVLMNQPDTALAHLAALLPKPEAARRIVELLNLFDPLDLVALEIRAQVGNAMS

SEQ ID NO: 73 - DNA, 900 bp, Corynebacterium glutamicum
  CDS (101)..(877): RXN01837
cccccatcattccctcaaggtgtgaagatacggttaggatagaaaagaatttttttgacgttggacattctcaaaatcaagtagcaagggatcaaactctgtgagtactaataaggaacgacgccaacaggcgctttcccagctggagaaagaaatcaaaagccgggaccgcaaagaaaagaccaagccactaaccgtggtctttgcttccctggctgtcatcctggttgtcgttggcggtatctggtacgcagctacccgcagcaccgaagacgaagtcatcaccgctgatgaaacatccaccaccgcagagacccctgactaccagccactggcgctgacccgcaccaccgcgctcggcgactccgtgacctgtgagtacccagatgctggcgaggcttccaaggatgtctccaagcctgctactgaaaacgtgccagcaaccggcaccgtgaccgtcaacctgaccaccgcccagggcaacatcggcatggaacttgatcgctccgtatccccttgtaccgtcaacgctgttgagcacatggcttccgagggctactacaacgatactgtctgccaccgcatcaccacctctggcatttacgttctccagtgcggcgatccaagcagcaccggcgcaggcggcccagggttcagcttcgccaacgaatacccaaccgacgaagcaactgacctaaccaccccagtcatctacgagcgcggcaccatcgccatggccaacgctggcgctgacaccaacgggctcccagttcttcctcaactacgaggattccccactggcaccgaactacacctacttcggccagatcaccgaagaaggccttgcaaccctcgacgccatcgcagaagttggcactgaaggtggaaccggcgacggag

SEQ ID NO: 74 - protein, 259 aa, Corynebacterium glutamicum
VSTNKERRQQALSQLEKEIKSRDRKEKTKPLTVVFASLAVILVVVGGIWYAATRSTEDEVITADETSTTAETPDYQPLALTRTTALGDSVTCEYPDAGEASKDVSKPATENVPATGTVTVNLTTAQGNIGMELDRSVSPCTVNAVEHMASEGYYNDTVCHRITTSGIYVLQCGDPSSTGAGGPGFSFANEYPTDEATDLTTPVIYERGTIAMANAGADTNGLPVLPQLRGFPTGTELHLLRPDHRRRPCNPRRHRRSWH

SEQ ID NO: 75 - DNA, 741 bp, Corynebacterium glutamicum
  CDS (1)..(741): RXN01926
ctgcgaagcttctacaccccagaacaagccatcgaacgcgaaggcgacgtctggaaagccgccaccgaagaagcagaactcctcgcagctgacggcgccgtccacgaccaggaactcttcctcaactgcaccacctccccactgatcttcgcctccgcgatgctcaacttcggcgtccaccaaatcctggacaccctctgccaactcgcaccatcccccgccggccgcgacgcagaccccaaagccctcgaagccgccacctccgcaatggacgaccaccgcgacaccaccgacgacttctccggcgtcgtcttcaaagtccaagccggcatggacaaaaaccaccgcgataccctcgccttcatgcgcgtcgtctccggcgaattcgaccgcggcatgcaagtcacccactcccaatccggccgcagcttctccaccaaatacgccctcaccgtcttcggccgcacccgctctaccgtcgaaaccgccttccccggcgacatcgtcggcctcgtcaacgccggcgccctcgcaccaggcgacaccatcttcgaaggccgaaaaatccaatacccaccaatgccaaaattcgcgccagaacacttccgcatcctgcgcgccaaatcactcggcaaatacaaacagttccgcaaagccctcgagcagctggactccgaaggtgtcgtccagatcctcaagaacgacctgcgtggcgacgccaacccaggtcatggccggtgt

SEQ ID NO: 76 - protein, 247 aa, Corynebacterium glutamicum
LRSFYTPEQAIEREGDVWKAATEEAELLAADGAVHDQELFLNCTTSPLIFASAMLNFGVHQILDTLCQLAPSPAGRDADPKALEAATSAMDDHRDTTDDFSGVVFKVQAGMDKNHRDTLAFMRVVSGEFDRGMQVTHSQSGRSFSTKYALTVFGRTRSTVETAFPGDIVGLVNAGALAPGDTIFEGRKIQYPPMPKFAPEHFRILRAKSLGKYKQFRKALEQLDSEGVVQILKNDLRGDANPGHGRC

SEQ ID NO: 77 - DNA, 478 bp, Corynebacterium glutamicum
  CDS (101)..(478): RXN02002
aagtggcaaaaaacgtttcaagcaggcaacgccggcgtacaacttcgctgagctggggcgattatggcccagcgcccacaacccgctattcttaatacccatgagcaacgccaattccgacaccaccgccgccgaggcacatcgccgcagaacattcgccgtaatcgcacaccccgacgccggtaaatccaccctcaccgaggcattggcgctgcatgcacacatcatctccgaagccggcgccacccacggcaaagcaggccgcaaagccaccgtttccgactggatggaaatggaaaaagaccgcggcatctccatcgcctcctccgcactccaattcgagtacgcaccagaaggccacgcaggcgagcccttcatgatcaacctcgtggacaccccaggccacgccgacttctccgaagacacctaccgcgtcctcatggccgtcgacgcagcagtcatgcttatgcactccgtc

SEQ ID NO: 78 - protein, 126 aa, Corynebacterium glutamicum
MSNANSDTTAAEAHRRRTFAVIAHPDAGKSTLTEALALHAHIISEAGATHGKAGRKATVSDWMEMEKDRGISIASSALQFEYAPEGHAGEPFMINLVDTPGHADFSEDTYRVLMAVDAAVMLMHSV

SEQ ID NO: 79 - DNA, 1080 bp, Corynebacterium glutamicum
  CDS (101)..(1057): RXN02736
cagaggattacccagcgggtacgtggggtccaaagagcgctgatgaaatgctttcccgcaacggtcacacctggcgcaggccataatttaggggcaaaaaatgatctttgaacttccggataccaccacccagcaaatttccaagaccctaactcgactgcgtgaatcgggcacccaggtcaccaccggccgagtgctcaccctcatcgtggtcactgactccgaaagcgatgtcgctgcagttaccgagtccaccaatgaagcctcgcgcgagcacccatctcgcgtgatcattttggtggttggcgataaaactgcagaaaacaaagttgacgcagaagtccgtatcggtggcgacgctggtgcttccgagatgatcatcatgcatctcaacggacctgtcgctgacaagctccagtatgtcgtcacaccactgttgcttcctgacacccccatcgttgcttggtggccaggtgaatcaccaaagaatccttcccaggacccaattggacgcatcgcacaacgacgcatcactgatgctttgtacgaccgtgatgacgcactagaagatcgtgttgagaactatcacccaggtgataccgacatgacgtgggcgcgccttacccagtggcggggacttgttgcctcctcattggatcacccaccacacagcgaaatcacttccgtgaggctgaccggtgcaagcggcagtacctcggtggatttggctgcaggctggttggcgcggaggctgaaagtgcctgtgatccgcgaggtgacagatgctcccaccgtgccaaccgatgagtttggtactccactgctggctatccagcgcctggagatcgttcgcaccaccggctcgatcatcatcaccatctatgacgctcatacccttcaggtagagatgccggaatccggcaatgccccatcgctggtggctattggtcgtcgaagtgagtccgactgcttgtctgaggagcttcgccacatggatccagatttgggctaccagcacgcactatccggcttgtccagcgtcaagctggaaaccgtctaaggagaaatacaacactatgg

SEQ ID NO: 80 - protein, 319 aa, Corynebacterium glutamicum
MIFELPDTTTQQISKTLTRLRESGTQVTTGRVLTLIVVTDSESDVAAVTESTNEASREHPSRVIILVVGDKTAENKVDAEVRIGGDAGASEMIIMHLNGPVADKLQYVVTPLLLPDTPIVAWWPGESPKNPSQDPIGRIAQRRITDALYDRDDALEDRVENYHPGDTDMTWARLTQWRGLVASSLDHPPHSEITSVRLTGASGSTSVDLAAGWLARRLKVPVIREVTDAPTVPTDEFGTPLLAIQRLEIVRTTGSIIITIYDAHTLQVEMPESGNAPSLVAIGRRSESDCLSEELRHMDPDLGYQHALSGLSSVKLETV

SEQ ID NO: 81 - DNA, 331 bp, Corynebacterium glutamicum
  CDS (101)..(301): RXS03217
tctgtgaaggtagatggtttgacgaggagttccaacgactcggacgctggtgaatcatgctggcgaacgtagcatcacctgattaggaaaaggtacaaatatggcacagggtactgtgaaatggttcaacggcgaaaagggatttggtttcatcgctcccaacgatggctccgcagatctcttcgtccactactctgagattcagggctccggtttccgtaatcttgaggaaaaccagccagttgaatttgaggtcggcgagggcgccaagggcccacaggctcagcaggttcgtgctctctaagctctaactgctagctaaaaattccgc

SEQ ID NO: 82 - protein, 67 aa, Corynebacterium glutamicum
MAQGTVKWFNGEKGFGFIAPNDGSADLFVHYSEIQGSGFRNLEENQPVEFEVGEGAKGPQAQQVRAL

SEQ ID NO: 83 - DNA, 324 bp, Corynebacterium glutamicum
  CDS (101)..(301): FRXA01917
tctgtgaaggtagatggtttgacgaggagttccaacgactcggacgctggtgaatcatgctggcgaacgtagcatcacctgattaggaaaaggtacaaatatggcacagggtactgtgaaatggttcaacggcgaaaagggatttggtttcatcgctcccaacgatggctccgcagatctcttcgtccactactctgagattcagggctccggtttccgtaatcttgaggaaaaccagccagttgaatttgaggtcggcgagggcgccaagggcccacaggctcagcaggttcgtgctctctaagctctaactgctagctaaaa

SEQ ID NO: 84 - protein, 67 aa, Corynebacterium glutamicum; identical to SEQ ID NO: 82

SEQ ID NO: 85 - DNA, 504 bp, Corynebacterium glutamicum
  CDS (101)..(481): RXA02184
tttaccgcgatgcttgcggtgtataataatttcttctggtcaaaaatagttgatcaatttgaatcagcatatgaattaggaatgaaagtggtgaggacaagtgcctgtcggaacagtgaagtggtacgacgcggagcgtggtttcggctttgtctccaatccaggtggtgaagattgcttcgtaggtaagcaagtacttcccaagggagtcaccgaattgcacaagggacagcgaatcgattttgacttcgccgcaggccgtaagggccctcaagcacttcgaataaagattcttgaaactccacgcaggcgtccacagcacaaatacaagccagaagagctcaacggaatgatctctgacctcatcacgcttctagaaagtggagtgcaaccaggccttgccaaagggcaatacccggagcacaaagctggagcgcaggtagcagaaattcttcgcgttgttgcgaaggagcttgagtcttaaaacaataaggagaggatccg

SEQ ID NO: 86 - protein, 127 aa, Corynebacterium glutamicum
VPVGTVKWYDAERGFGFVSNPGGEDCFVGKQVLPKGVTELHKGQRIDFDFAAGRKGPQALRIKILETPRRRPQHKYKPEELNGMISDLITLLESGVQPGLAKGQYPEHKAGAQVAEILRVVAKELES

SEQ ID NO: 87 - DNA, 324 bp, Corynebacterium glutamicum
  CDS (101)..(301): RXA00810
tcggcgttcgttcaagaaacggccagatgttgctgttcgagctcatgcaagagtggaacatcgaacccggtagtaattccaatcagtaaaggtaagacaaatggcacagggcactgttaagtggttcaacccagagaagggcttcggcttcatcgctccttccgacggatccgctgacgttttcgtccactactccgagatcgagggcaacggcttccgtaccctcgaggagaaccagctcgtcgagttcgaaatcggcgagggcgctaagggccttcaggctcaggctgttcgtgcaatctaattgcatctgagttcgaaacc

SEQ ID NO: 88 - protein, 67 aa, Corynebacterium glutamicum
MAQGTVKWFNPEKGFGFIAPSDGSADVFVHYSEIEGNGFRTLEENQLVEFEIGEGAKGLQAQAVRAI

SEQ ID NO: 89 - DNA, 1017 bp, Corynebacterium glutamicum
  CDS (101)..(994): RXA01674
cggcgtcgattccagaaggtttgtagacatgcttcaaggttgcgctaattgaaaagaacgcggtagacggtactttcatatccacccatataatgttgatatggataatgggtggccgaacctgcaaactctcgcactctttgtggcgattgtggaagaggggagcctcggtgccggtgctcgaaaagtcggaatggcccaacctaatgccagtcgggctatcgcagagcttgaggcagacatgaaagccgaattgttggtacgtcatcctcgaggatcacatccaacagctgctggacttgcgcttgttgagcattcgcgcgatctgcttcaatctgtacaagaatttactgaatgggtgacagagggacgaactgagcagccgctgaaattgcatgttggggccagtatgaccattgccgaggctctacttccagcttgggttgcggacatgcgcacgcgttttcctgcctgccgtgtcgacgtctctgtgatgaattcttctcaagtaattgaagccgtccagaaagggcacttgcaactaggttttattgaaacaccgcatgttcccgtacggcttcatgctcgtgtggtgcaagaggacaagctgattgtggtgatttctcctaatcatgagtgggctaatcgcacgggtaggatcagtcttcgggagttgtcggaaactccgctgatagtgagggaagtcggctcaggtacccgagaagcattacaagaattacttgcggattatgacatggctgagccgattcaagtgttaaacagcaatgctgcggtacgtgttgttgttgaagcaggggcaggtcctgcagtacttggtgaattagccttgcgtgatcatcttgcgctcggcaggctgttgagtgtgccatttgaaggcagtggagttactcgtcctcttacagctgtgtggagtggaccccgcagattgccgattctagcgggagaattagtgtccatcgcatcgaaccacatctgattttgagccctggctaacgg

SEQ ID NO: 90 - protein, 298 aa, Corynebacterium glutamicum
MDNGWPNLQTLALFVAIVEEGSLGAGARKVGMAQPNASRAIAELEADMKAELLVRHPRGSHPTAAGLALVEHSRDLLQSVQEFTEWVTEGRTEQPLKLHVGASMTIAEALLPAWVADMRTRFPACRVDVSVMNSSQVIEAVQKGHLQLGFIETPHVPVRLHARVVQEDKLIVVISPNHEWANRTGRISLRELSETPLIVREVGSGTREALQELLADYDMAEPIQVLNSNAAVRVVVEAGAGPAVLGELALRDHLALGRLLSVPFEGSGVTRPLTAVWSGPRRLPILAGELVSIASNHI

SEQ ID NO: 91 - DNA, 1214 bp, Corynebacterium glutamicum
  CDS (1)..(1191): RXA02431
gtggtggtgacaccccgtcatatcgtttactccgcagcctcgcgccgggtgttccaaatcgtggaaaaacgcgccggaattgtcgaacgcctcagcatcgatgaaggcttcatggaaccagaggctctcgttggagccaccccagaagaggtgaaacagtgggcggaagaattacgcgcggaaattaaagaagttactggcttaccctcctcggttggtgctggctccggtaagcagatcgccaaaattggttcaggcgaagcaaagccagatggtgtgtttgtcgtgccagtagacaagcaacatgacttgcttgatccacttcctgtgggcgcactttggggagtgggtcctgtgacaggctccaagcttgcctcaatgggggtggaaacaattggtgatctagcagcgctaacccaaaaagaagtagaaatcagcctcggtgcaaccatcggaatatcactgtggaaccttgcccgaggaatcgacgaccgccctgtggaaccccgcgccgaagcaaaacagatctcccaagagcacacctatgaaaaagacctcctcaccaggcaacaagtagatgctgccatcattcgatcagccgaaggcgcacaccgacggctcctcaaagacggacgcggtgccagaactgtcagcgtgaaactgcggatggccgactttcgtattgagtctcgttcctacaccttgtcctatgccaccgatgattacgcaactcttgaggcaacagcattccgacttgcccgctaccccggagaagtaggccccatccgccttgtcggagtaagtttttctggtttggaagaatcccgccaagacatcctcttcccggaacttgaccaacaaatcatcgtaccaccagcacccgacaccgattatgaggtaggcgtgcaatcctcttctagttccgaaagtactcaagttgaagcgccgcaagatgtcgcgttgagtatgtggtgcgcaacgcaagatgtctaccacccagaatatggccacggttgggtacaaggtgccggtcacggtgttgtatcagtacgttttgaaacccgcagcaccacaaaagggcgaactaaaagtttttccatggatgacccggacctcaccccggcagaccctctagatagtttggattgggctgactggtttgctgaaaatggtgaaacgggggatgacgaatagggtttcatcgggtttcgggg

SEQ ID NO: 92 - protein, 397 aa, Corynebacterium glutamicum
VVVTPRHIVYSAASRRVFQIVEKRAGIVERLSIDEGFMEPEALVGATPEEVKQWAEELRAEIKEVTGLPSSVGAGSGKQIAKIGSGEAKPDGVFVVPVDKQHDLLDPLPVGALWGVGPVTGSKLASMGVETIGDLAALTQKEVEISLGATIGISLWNLARGIDDRPVEPRAEAKQISQEHTYEKDLLTRQQVDAAIIRSAEGAHRRLLKDGRGARTVSVKLRMADFRIESRSYTLSYATDDYATLEATAFRLARYPGEVGPIRLVGVSFSGLEESRQDILFPELDQQIIVPPAPDTDYEVGVQSSSSSESTQVEAPQDVALSMWCATQDVYHPEYGHGWVQGAGHGVVSVRFETRSTTKGRTKSFSMDDPDLTPADPLDSLDWADWFAENGETGDDE

SEQ ID NO: 93 - DNA, 558 bp, Corynebacterium glutamicum
  CDS (101)..(535): RXA02446
caggaaatcttgctgtctaatgcacaacggaaaactgctcacggacgaactagttgtagcgagcgtattctttgtgttctctcacgacaggaatactgctatggcgatcgagtccatcgcgtacaccagtgaagcactctcaaccggcagtggccggctggggcatgtgcgctccacagatggtgcgctcgaatttgaaatgacaccgccaaaggctttgggcggatccggtgaaggcaccaatccagaacagctgttcgcggtaggttacgcagcctgtttccactctgccatgcactctgtcgcacgcagccgcaagatcactcttgaagacacagcggttggtgcccgagttagcatcgggccaaacggcgctggtggatttgagattgccgtagaactcgaagtatcgattcctcaattgccacaagcagaagcccaggaacttgctgatgccgcgcaccaggtgtgcccgtattccaacgccacacgaggcaatatctcggtaactgtgtcagtcatcgacgaagaggcttaaaaccacaggattaacaaaac

SEQ ID NO: 94 - protein, 145 aa, Corynebacterium glutamicum
MAIESIAYTSEALSTGSGRLGHVRSTDGALEFEMTPPKALGGSGEGTNPEQLFAVGYAACFHSAMHSVARSRKITLEDTAVGARVSIGPNGAGGFEIAVELEVSIPQLPQAEAQELADAAHQVCPYSNATRGNISVTVSVIDEEA

SEQ ID NO: 95 - DNA, 1206 bp, Corynebacterium glutamicum
  CDS (101)..(1183): RXA02861
ccctcgattattacaatccggctacttcggaagcgtttgtggccggatttttctatcctggaaggtattaatacttctttaagggtcggaggattttcgtatgtctactagaacaacgccacaagaccgttataccgacgaatacggcatcgaacgcgtcaacaaggatgaacccggcctggtggacaaactccgggacaagcacgactggtttgatcatctcatgcgcatgaatgaacgtttcggcgcaaaaggtggcaaccaattgtcggcgggtattacgtatttctccgtgctgtcgatcttcccgattgccatgcttgtcttcggtattgcaggtgtcatccttgccggaaaccctgaagttctcacagatattcaaaatcgaatcaacgatgctttagaaggcgagatcggtaacaccgtcaacggcatcattgattccgcgattgcgcagcgtggtgctgtgttgggcattggtggtgtaactgccctgtggtctggactggggtggatggcgaacctgcgctttggagtttcccgcatgtgggccattgacccaactgaaggcaacttcattcaaaagaagctcaccgacttggtcgcgctgatcgtcttgctgctggccatgggcgtagccttcggtatcacggcgctcggtgcttccggactaaccaaaaacctgctggactttgtgggcctgggggagattccgggcattagctacatcacctgggtggtcgcagcacttgttggtgtcttggctaacttcctggtgttcatgtggctgattttctccctgccacgtaccaaagttcccatgaaaccgggtcttcaggcagcactgcttggcgcaatcggttttgaggtggtcaagcaggttggatcgctgttggcttcaaatgcattgagtaaccccgcgggtgcagcattcggtccgatcatcggcatcatggttgtgctgtatttgatctggcgcatcctcatgtattgctctgcgtgggctgccaccagtgaagaagcgttgcgtcttgcgactgttccagcaccagagcctgcgatcattcgggttcgccatgaaattgatccaggtgaagaagtctcccaatctgctcgaaaagtgggcattggagtggccgtgggtgccgcgactgcgggtgcttttgcgctgttgcgtaaaaaatagtttttattaagggcattccc

SEQ ID NO: 96 - protein, 361 aa, Corynebacterium glutamicum
MSTRTTPQDRYTDEYGIERVNKDEPGLVDKLRDKHDWFDHLMRMNERFGAKGGNQLSAGITYFSVLSIFPIAMLVFGIAGVILAGNPEVLTDIQNRINDALEGEIGNTVNGIIDSAIAQRGAVLGIGGVTALWSGLGWMANLRFGVSRMWAIDPTEGNFIQKKLTDLVALIVLLLAMGVAFGITALGASGLTKNLLDFVGLGEIPGISYITWVVAALVGVLANFLVFMWLIFSLPRTKVPMKPGLQAALLGAIGFEVVKQVGSLLASNALSNPAGAAFGPIIGIMVVLYLIWRILMYCSAWAATSEEALRLATVPAPEPAIIRVRHEIDPGEEVSQSARKVGIGVAVGAATAGAFALLRKK

SEQ ID NO: 97 - DNA, 753 bp, Corynebacterium glutamicum
  CDS (101)..(730): RXA00981
aaccaatggctgggtactgatgtggtgatcagtgcccagtttcttctttctactagtgtcggatagaagtacccccagtccagaatgaaggtcaccaccaatgtcagagaatttgccagcgcccgagaatctcctggacgccgagagaattcagatgatcaagaacttccgcaacgaattaacggggttcatgctcaactaccaatttggcattgatgagatcctgaccaagatcaacatcctgaaaactgaattcagccagctgcacgaatacgcacctatcgagcacgtatcttcacgattgaagacaccagaaagcatcgtcaaaaaggtcatccgaaaaggagacgagctctccctcgcagctatcaaagacacagtgtttgatatcgcaggcattcgaatcgtctgcagtttcctcaaagatgcctacgcaatcgccgatatgctgaccaaccaaaaagacgtcacggtcatcgaggccaaagactacatcgctaacccaaagccgaacggctacaagagtttgcaccttatcctccaagtgcctgtcttcctgtctaactccgtggaaaaggtcaatgttgaagtccagatccgcaccattgccatggacttctgggcaagcctcgagcacaaaatctactacaaatttgaacaagaagttcctcagtcaatccttgatgagctcagtgaagatggaaagaatccacggggaagtgaagtcacttaaacctccagttgaaaccactg

SEQ ID NO: 98 - protein, 210 aa, Corynebacterium glutamicum
MSENLPAPENLLDAERIQMIKNFRNELTGFMLNYQFGIDEILTKINILKTEFSQLHEYAPIEHVSSRLKTPESIVKKVIRKGDELSLAAIKDTVFDIAGIRIVCSFLKDAYAIADMLTNQKDVTVIEAKDYIANPKPNGYKSLHLILQVPVFLSNSVEKVNVEVQIRTIAMDFWASLEHKIYYKFEQEVPQSILDELSEDGKNPRGSEVT

SEQ ID NO: 99 - DNA, 1098 bp, Corynebacterium glutamicum
  CDS (101)..(1075): RXN00786
tccttcttccaccagctaaaagtgaattaccccgcctttgtcggggtggttgcattcccagtctaggtgtttagcctcaacgttggatacgctgggaggcatgagctcacctgttatcagccccgaaaccaaaaccggaaagaagatcctgcttgcagcccctcgcggatactgtgccggcgtagaccgtgcagtggaaaccgtcgagcgcgcgctcgaggaatacggcgccccaatttatgtccgtaaagaaatcgtgcacaaccgttacgttgtggacaccctggcagaaaagggcgcgatttttgtcaacgaagcatctgaagcaccagaaggtgccaacatggtgttctctgcacacggcgtgagcccaatggtccacgaagaagctgcagctaaaaacatcaaggctattgacgcggcctgcccgctggtcaccaaagtgcacaaggaagtccagcgctttgataagcagggattccacattctcttcatcggtcacgaaggccatgaagaagtagagggcaccatgggtcattccgttgagaaaacccacctggttgacggcgttgctggcattgccaccctgcctgaattcttaaacgatgaaccaaacctgatctggctgtctcagaccacgctttctgtggacgagaccatggagatcgtccgcgagctgaaggtgaagttccctcagctgcaggatccaccgtcagatgatatttgctacgccacgcagaaccgccaggttgccgtcaaggctatcgctgagcgctgcgagctgatgattgtggtcggttcccgcaactcctccaactcggttcgtctggttgaggtcgctaagcaaaacggtgccgataacgcctacctggtggattacgcccgcgaaatcgacccagcatggttcgaaggcgtagagaccatcggtatctcctccggcgcttccgtgcctgagatcctcgtccagggcgtcattgagcgcctggctgagttcggctacgacgacgtcgaggaagtcacctccgccgctgagaagattgttttcgcgctgcctcgcgtgctgcgccacaagaattaattgcaagaatgaaaaatccc

SEQ ID NO: 100 - protein, 325 aa, Corynebacterium glutamicum
MSSPVISPETKTGKKILLAAPRGYCAGVDRAVETVERALEEYGAPIYVRKEIVHNRYVVDTLAEKGAIFVNEASEAPEGANMVFSAHGVSPMVHEEAAAKNIKAIDAACPLVTKVHKEVQRFDKQGFHILFIGHEGHEEVEGTMGHSVEKTHLVDGVAGIATLPEFLNDEPNLIWLSQTTLSVDETMEIVRELKVKFPQLQDPPSDDICYATQNRQVAVKAIAERCELMIVVGSRNSSNSVRLVEVAKQNGADNAYLVDYAREIDPAWFEGVETIGISSGASVPEILVQGVIERLAEFGYDDVEEVTSAAEKIVFALPRVLRHKN

SEQ ID NO: 101 - DNA, 1131 bp, Corynebacterium glutamicum
  CDS (101)..(1108): RXS01027
aatagatggaagtagtttttcattcacttatgtgcgcgtttttaatctggtttctaccaagaactgtgtgcaccacaacgcggaaggtgaatcgcacccaatggcaaataagaacaataagcctcatgaggtggacaaagaccaagattcagccatgctgatcaacggtcgcctgcaacagatcccggcgcgtcccactgaggaattcacccgcccaactcttgcagcaggtgcagtactgtggcgcggcgacatcaccaacccggacagcatcgaggtcgctgtcatccaccgcccgcactatgatgactggtccctggccaagggcaaagtcgatcccggcgagtctattccgacaaccgcggcccgtgaaatccttgaagaaactggctacgacatccgtctgggcaagctgatcggcaaggttacttaccctgtgctcgaccgaaccaaagtggtctactactggactgcccaggttcttggtggagagtttgtccccaacgatgaagttgatgaaatccgttggctgtctgttgatgaagcatgcgagttgctcagctaccaagtagataccgaagttctggccaaggcagcaaagcgtttccgcactccttccaccactcgggtgctgtatgttcgccatgctcatgcacatggtcgccaaacctggggtggcgacgacaataagcgcccattggacaaaaaggggcgtcgacaagcagaaatgctcgtacccatgttgttgcccttcaaacccaccgcaatttactcggcggtgcccgatcgctgccaagccaccgcgctcccccttgccgatgagctcggcctcgacgtgtccgtcaaccgactgttcggcgacgacgcctgggaaaccgatcccgaggcctgcaagaagcgcttcaccgacgtggtcgcgcaaggtggcgtgccgatgatcgttgggcagggcgacatcattccggaaatgatcaaatggttctccgagaacggcaccctccctatcgatgagaagatcaaggcgaaaaagggcagcgtgtgggtgttgagctttcacgacggtgtgttcaccggcgctgattacctggcgagttccctgccggttaaataggagcgcgtttaaggcctcca

SEQ ID NO: 102 - protein, 336 aa, Corynebacterium glutamicum
MANKNNKPHEVDKDQDSAMLINGRLQQIPARPTEEFTRPTLAAGAVLWRGDITNPDSIEVAVIHRPHYDDWSLAKGKVDPGESIPTTAAREILEETGYDIRLGKLIGKVTYPVLDRTKVVYYWTAQVLGGEFVPNDEVDEIRWLSVDEACELLSYQVDTEVLAKAAKRFRTPSTTRVLYVRHAHAHGRQTWGGDDNKRPLDKKGRRQAEMLVPMLLPFKPTAIYSAVPDRCQATALPLADELGLDVSVNRLFGDDAWETDPEACKKRFTDVVAQGGVPMIVGQGDIIPEMIKWFSENGTLPIDEKIKAKKGSVWVLSFHDGVFTGADYLASSLPVK

SEQ ID NO: 103 - DNA, 651 bp, Corynebacterium glutamicum
  CDS (101)..(628): RXS01528
cacccaaacccaaacctctcagtcgaataagcagaagtctcaggacaaccgcaggggtaagggtcgtaggtctccaaccaggaggcgttccaacacgagggtgaatcaggcgtggcagcagtcccgtttggttacttctgatgagacttccgcaggtggtctcgtggtgtcaggtttggctgaggcggtcaacgctaacaatgaggttgatctgtcgaagatttatgttgcgttgattggtcgccttgatcgtcgtggtcgtttgttgtggtcgatgccgaagggccatgttgagcctggtgaggataaggctgcgactgctgagcgtgaggtgtgggaggagaccggcatccacggtgaggtgttcactgagttgggtgtgattgattattggttcgtttcggaagggaagcggatccataagacggtgcatcatcatttgttgcgttatgttgatggcgatttgaatgatgaggatccagaagtcactgaggtggcgtggattccggcgaatcagttgattgagcatttggcttttgcggatgagcggaagttggctaggcaggcgcatgatttgttgcctgagtttgctttgaaggaaaaggcggagggaaggtccaccccaaggtgattccgaaccccaacccgaac

SEQ ID NO: 104 - protein, 176 aa, Corynebacterium glutamicum
VNQAWQQSRLVTSDETSAGGLVVSGLAEAVNANNEVDLSKIYVALIGRLDRRGRLLWSMPKGHVEPGEDKAATAEREVWEETGIHGEVFTELGVIDYWFVSEGKRIHKTVHHHLLRYVDGDLNDEDPEVTEVAWIPANQLIEHLAFADERKLARQAHDLLPEFALKEKAEGRSTPR

SEQ ID NO: 105 - DNA, 509 bp, Corynebacterium glutamicum
  CDS (1)..(486): RXS01716
gaagtcactcctgagggattcaaagagatcacccgtgaaaacaccatcgttcgcctgggcaaaggcgtcgacgccaccggtcagctagaccccgaggcaatcgagcgcactcgtgtcgctttggaaaactacgttgaactcatggaaacccatggggtagaggccgtacgaatggttgccacctccgcaacccgcgatgcgtccaaccgcgatgaattcttttcgatgacccgccagcttctgtccaagatccgtcctggataccaagctgaagtaatttccggcgaagaggaagctctgctgtccttccgaggtgcaatcgttgacctgcctgaagaccaaggtcctttctgtgttatcgaccttggcggtggatccactgagttcatcgttggcacctacgacggtgaaatcctaggctcccactcaacccaaatgggatgcgtgcgcctgaccgaacgaatcatgcgcagcgacccacccgactgaaaccgaagtggaaatcgccc

SEQ ID NO: 106 - protein, 162 aa, Corynebacterium glutamicum
EVTPEGFKEITRENTIVRLGKGVDATGQLDPEAIERTRVALENYVELMETHGVEAVRMVATSATRDASNRDEFFSMTRQLLSKIRPGYQAEVISGEEEALLSFRGAIVDLPEDQGPFCVIDLGGGSTEFIVGTYDGEILGSHSTQMGCVRLTERIMRSDPPD

SEQ ID NO: 107 - DNA, 654 bp, Corynebacterium glutamicum
  CDS (101)..(631): RXS01835
tcaacatctattcctcctgcgatttgcatgggatatatattaaaaattctagccgaaagtttcctgcgtgaatacactttccccgcgccttcgcaaagctatgaatactgccgcgtgggcacaccgccaccacgtacgcaaaggcggtggaattccgtatgtcagccatctttattcagtgatgtacttgctggccagcgtcactaatgatgaagatgtgctcatcgccgggctgctccacgacaccctcgaagacgtacccgaggaatacaattctgcccaacttgaagctgattttggtccgcgggtgcgcgagttggtggaagagctcaccaaacagcccttaaaaagctggaaagcgcgtgccgacgcttacctcctgcacctcagcgcaggtgccagcttagaggctgtcttaatctccaccgcagataaactgcataatctcatgtccatcttggatgaccttgaaatacacggtgaagatttatggcaacgctttaacgctggcaaagagcagcaaatctggtggtatagcgaggtttatcagatatctctccagcgcttagggttcaatgagttgaataaacaactggggttgtgcgtcgaaaagctcttaaagcaaagcgcctaggcgctcggcggcgtcgataa

SEQ ID NO: 108 - protein, 177 aa, Corynebacterium glutamicum
MNTAAWAHRHHVRKGGGIPYVSHLYSVMYLLASVTNDEDVLIAGLLHDTLEDVPEEYNSAQLEADFGPRVRELVEELTKQPLKSWKARADAYLLHLSAGASLEAVLISTADKLHNLMSILDDLEIHGEDLWQRFNAGKEQQIWWYSEVYQISLQRLGFNELNKQLGLCVEKLLKQSA

SEQ ID NO: 109 - DNA, 1050 bp, Corynebacterium glutamicum
  CDS (101)..(1027): RXS02497
tcgatgccgccgctggcgaagactcggggaaacctaaaaataccgaagaagaatttgaccgattcacactttgccaccctagaccgtctaacctttaggtgtgagattaggtgtattagatgtgggcagcaatactgtccacctagttgcagtagacgcgcgtcccggtggacaccccaccccgatgagcaattggcgtaccccactgcgccttgttgagcttcttgatgactccggggcgatctccgaaaagggcatcaacaaactcacctcagcagtcggggaagcagcagacctagcgaaaacgctcggctgcgctgaactgatgccatttgctacatcggcagtccgctccgccaccaacagcgaggcagtgctcgaccacgtggagaaggaaaccggcgtccgcctgtccatcctttccggtgaagacgaagcacgccaaactttcctcgcagttcgacgttggtatggatggtccgcagggcgcataactaacctcgacatcggtggcggctccctggaactatcctccggaaccgacgaatccccagacctcgcgttctcactggatctgggtgcgggccgcttgacccacaactggttcgacaccgatccaccggcacgtaagaaaatcaacctcctgcgcgattatatcgatgcggaacttgcagaacccgcccgccagatgcgcaccctagggcccgcgcgcctggcagtgggaacatccaaaactttccgcaccctggcacgactgactggtgctgcgccctcatccgcaggaccacacgtcacccgaaccctcaccgcgccgggtctgcgccagctgatcgcatttatctcacgaatgactgcggcggaccgcgctgagctggaaggtatcagctcggatcggtcacatcagatcgtggcaggtgcgctagttgcggaagctgcgatgcgtgcgttggatattgacaaggtagaaatttgtccgtgggcacttcgtgaaggtgtgatcctcaccaggatcgacaaaggactcgagtaacatttacccggaaaggagtt

SEQ ID NO: 110 - protein, 309 aa, Corynebacterium glutamicum
VRLGVLDVGSNTVHLVAVDARPGGHPTPMSNWRTPLRLVELLDDSGAISEKGINKLTSAVGEAADLAKTLGCAELMPFATSAVRSATNSEAVLDHVEKETGVRLSILSGEDEARQTFLAVRRWYGWSAGRITNLDIGGGSLELSSGTDESPDLAFSLDLGAGRLTHNWFDTDPPARKKINLLRDYIDAELAEPARQMRTLGPARLAVGTSKTFRTLARLTGAAPSSAGPHVTRTLTAPGLRQLIAFISRMTAADRAELEGISSDRSHQIVAGALVAEAAMRALDIDKVEICPWALREGVILTRIDKGLE

SEQ ID NO: 111 - DNA, 534 bp, Corynebacterium glutamicum
  CDS (101)..(511): RXS02972
acctacgacggtgaaatcctaggctcccactcaacccaaatgggatgcgtgcgcctgaccgaacgaatcatgcgcagcgacccacccgactgaaaccgaagtggaaatcgcccgcgactacgttgcagaacgcatccaggaagtaaaagccatcgtcccaatttcaaaggcaaaaacctttgtgggatgcgcaggcaccttcaccacaatctccgcctgggtgcaaggcctagaaagctacgaccgcgacgcgatccacctctctgcactcaacttcgatgcactgcgagttgtcaccgatgagatcatttcagaatcatcatcacagcgcgccagcaacccagttgttgatccaggtcgcgccgacgtcatcggtggcggatccgttgttgtccaagcagcgatcgacttagcctccaaagaagccggtgtagactacatcattatttccgaaaaagacatcctcgacggcctcatccttggcctggtagaagccgactctttgaagaaataggaccctagttttaaaccact

SEQ ID NO: 112 - protein, 137 aa, Corynebacterium glutamicum
VEIARDYVAERIQEVKAIVPISKAKTFVGCAGTFTTISAWVQGLESYDRDAIHLSALNFDALRVVTDEIISESSSQRASNPVVDPGRADVIGGGSVVVQAAIDLASKEAGVDYIIISEKDILDGLILGLVEADSLKK

SEQ ID NO: 113 - DNA, 636 bp, Corynebacterium glutamicum
  CDS (101)..(613): RXA02159
tgatggaccagcgtccaaagttttcgatgaagcagaaaaccgcctccacgctcagaaagcactgctggtgtggctgctggccaaccagccgaggtaagacatgtcccttggctcaaccccgtcaacaccggaaaacttaaatcccgtgactcgcactgcacgccaagctctcattttgcagattttggacaaacaaaaagtcaccagccaggtacaactgtctgaattgctgctggatgaaggcatcgatatcacccaggccaccttgtcccgagatctcgatgaactcggtgcacgcaaggttcgccccgatgggggacgcgcctactacgcggtcggcccagtagatagcatcgcccgcgaagatctccggggtccgtcggagaagctgcgccgcatgcttgatgaactgctggtttctacagatcattccggcaacatcgcgatgctgcgcaccccgccgggagctgcccagtacctggcaagtttcatcgatagggtggggctgaaagaagtcgttggcaccatcgctggtgatgacaccgttttcgttctcgcccgtgatccgctcacaggtaaagaactaggtgaattactcagcgggcgcaccacttaaagcgcccctagttcaaggct

SEQ ID NO: 114 - protein, 171 aa, Corynebacterium glutamicum
MSLGSTPSTPENLNPVTRTARQALILQILDKQKVTSQVQLSELLLDEGIDITQATLSRDLDELGARKVRPDGGRAYYAVGPVDSIAREDLRGPSEKLRRMLDELLVSTDHSGNIAMLRTPPGAAQYLASFIDRVGLKEVVGTIAGDDTVFVLARDPLTGKELGELLSGRTT

SEQ ID NO: 115 - DNA, 486 bp, Corynebacterium glutamicum
  CDS (101)..(463): RXA02201
tctaccagccaaatcatcaactcatagcgaaggaatcaacttcatgaataatcaaccatcagtacttttcgtttgcgtcggcaatggtggaaaatctcaaatggccgcagcgctagccaaaaaacatgccggggacgctctcaaagtttattcagctggcacaaagccaggtacgaaattaaatcaacagtcccttgattccattgctgaagttggcgcagatatgtctcaagggtttccaaagggcattgaccaggagttaattaagcgagtagaccgcgtggtcattcttggtgccgaagctcaactagaaatgcctatcgatgcaaacggcatactacagcgctgggtaactgacgaaccctctgaacgtggaattgaaggtatggaacgcatgcgcctggtccgagatgatattgacgcccgagtccaaaacctcgtcgctgaactaacccaaaacgcatagcagttttctaatctcacaca

SEQ ID NO: 116 - protein, 121 aa, Corynebacterium glutamicum
MAAALAKKHAGDALKVYSAGTKPGTKLNQQSLDSIAEVGADMSQGFPKGIDQELIKRVDRVVILGAEAQLEMPIDANGILQRWVTDEPSERGIEGMERMRLVRDDIDARVQNLVAELTQNA

SEQ ID NO: 117 - DNA, 510 bp, Corynebacterium glutamicum
  CDS (101)..(487): RXA00599
gaacgatcggccctttgattgaagtcccagtattagtcggattggtttatgtcatgttgtggcttggaccaaaaatctttaaaaaggagaatgcaggatcatgaaatcagttttgtttgtgtgcgtcggtaatggcggaaaatcacagatggcggcggcgctggcacagaagtatgcatcagattcagtagagatccattctgctggaaccaagcctgcacaggggctaaaccaattgtctgtggaatccatcgctgaggtgggcgctgatatgtcgcaaggaattcccaaagcgatcgatccggagctgctgcgcactgtcgatcgtgtggttattttgggcgatgacgcacaggtagatatgcctgaatctgcacagggcgctcttgagcgttggtcaattgaggaaccggatgctcaaggtatggaacgtatgcgtattgtgcgggatcagatcgataaccgagtccaagctttgctagcgggataagcgccgaaaaaggggcatgt

SEQ ID NO: 118 - protein, 129 aa, Corynebacterium glutamicum
MKSVLFVCVGNGGKSQMAAALAQKYASDSVEIHSAGTKPAQGLNQLSVESIAEVGADMSQGIPKAIDPELLRTVDRVVILGDDAQVDMPESAQGALERWSIEEPDAQGMERMRIVRDQIDNRVQALLAG

SEQ ID NO: 119 - DNA, 1221 bp, Corynebacterium glutamicum
  CDS (101)..(1198): RXA00600
cggagttaatgagcggtaggtggatgggtgcggtcatgtccgtcattatatattgacgcacatcgatattgaaggtatttttatatcggcaaacatcaatatgattgaaggctggctcatgacccttactaaagagcattcgacacctcgagcggctggctcaatgtcgtttcttgaccgctggttagctgcctggattttcttggctatggctgctgggttgttaatcggcaaggtctttccaggaattggggcgcttttgagcgcggtggaaattggtggaatttccattccaattgctatcggtttgatcgtcatgatgtatccacctttggccaaggtgcgctacgacaaaactaaagaaatcagcacagaccgcgctctcatggtggtgtcgattatgttgaactggatcgttggaccagcacttatgtttagcctggcgtggctgtttcttccagatcaaccagagcttcgcactgggctaattatcgtgggccttgcgcgctgtatcgcgatggttttggtatggagtgatctcgcttgtggtgaccgggaagcaactgctgtgctggttgcaatcaactcggtgttccagatccttatgttcggtgtgcttggttggttttacctgcagattcttccctcgtggctgggattagacaccacgtcggtgactttctctgtggtatcaatcgtgacttccgttctcgtgttcttgggcataccacttgtagctggagttttatctcgcgtcattggtgaaaaaacaaagggacggcgctggtacgaggacacgttcctgcctaagatttcacccttggcgctgattggcttgctatacacaattgttctgctgttttcgttgcagggggatgaaatcacagcgcagccttggacagtagctcgtcttgcattgccgctgctgatgtactttgtgggcatgtttttcatttccctggtggtatccaaactgtccgggttaacttatgagcgagctgcttccgtgtcttttactgcagcaggaaacaactttgaattagcgattgcggtatcgatcggaacctttggtgcgacatcaccgcaggcattagctggaacgatcggccctttgattgaagtcccagtattagtcggattggtttatgtcatgttgtggcttggaccaaaaatctttaaaaaggagaatgcaggatcatgaaatcagttttgtttgtgtgc

SEQ ID NO: 120 - protein, 366 aa, Corynebacterium glutamicum
MIEGWLMTLTKEHSTPRAAGSMSFLDRWLAAWIFLAMAAGLLIGKVFPGIGALLSAVEIGGISIPIAIGLIVMMYPPLAKVRYDKTKEISTDRALMVVSIMLNWIVGPALMFSLAWLFLPDQPELRTGLIIVGLARCIAMVLVWSDLACGDREATAVLVAINSVFQILMFGVLGWFYLQILPSWLGLDTTSVTFSVVSIVTSVLVFLGIPLVAGVLSRVIGEKTKGRRWYEDTFLPKISPLALIGLLYTIVLLFSLQGDEITAQPWTVARLALPLLMYFVGMFFISLVVSKLSGLTYERAASVSFTAAGNNFELAIAVSIGTFGATSPQALAGTIGPLIEVPVLVGLVYVMLWLGPKIFKKENAGS

SEQ ID NO: 121 - DNA, 1233 bp, Corynebacterium glutamicum
  CDS (101)..(1210): RXA02200
attgtgtggagagtggtcataaatccactatatattgacgaatgtcgatattgaaagtattttgaatatcgacaggtatcaatataccgaaaggtgtcgcatgacaaactcaactcagacgcgggccaagccagcccgaatctcatttcttgataaatacattccactttggattattttggcgatggcgtttgggctatttttaggccggagcgtttcgggactctcaggctttctaggcgcaatggaagtcggagggatctccttgccaatcgctttaggcctccttgtaatgatgtacccaccgttggccaaagttcggtatgacaaaactaaacaaattgccactgataagcatttgatgggcgtgtcactcattctcaattgggtggtgggtcctgccttaatgttcgcgctagcttggttgttcctcccagaccaaccggaattacgaaccggcctgattattgtaggactcgcacgatgtattgcgatggtcttggtttggtctgatatgtcctgtggagaccgcgaggctacagcagttctcgtagccattaattcagtttttcaagtcgcaatgtttggtgcacttggctggttctatctgcaagttttaccatcctggctaggattaccaactaccaccgctcaattctctttctggtcaattgtgacttcggttttggtgttcctcggaatacctctacttgctggagttttctcgcgaattattggcgaaaagatcaagggacgtgagtggtatgaacaaaagttccttccggcaatctctccatttgcactaatcggtctgctttatacgatcgtcttgttgttttcattgcaaggtgatcagatcgtctctcaaccatgggctgtagttcgtctcgcgataccattggttatctatttcgttggaatgtttttcatttcactcattgcgtcaaaactatctggcatgaactatgcaaagtctgcatccgtctctttcactgcagctggcaacaattttgaacttgcgattgcggtgtcgatcggaacgtttggcgcaacttctgcacaggctatggcaggaacgattggtcccttgattgaaattccagtacttgtcggcttggtctacgccatgctgtggctaggccccaagttgttcccaaatgaccccacgctgccatcatcagctcgttctaccagccaaatcatcaactcatagcgaaggaatcaacttcatga

SEQ ID NO: 122 - protein, 370 aa, Corynebacterium glutamicum
MTNSTQTRAKPARISFLDKYIPLWIILAMAFGLFLGRSVSGLSGFLGAMEVGGISLPIALGLLVMMYPPLAKVRYDKTKQIATDKHLMGVSLILNWVVGPALMFALAWLFLPDQPELRTGLIIVGLARCIAMVLVWSDMSCGDREATAVLVAINSVFQVAMFGALGWFYLQVLPSWLGLPTTTAQFSFWSIVTSVLVFLGIPLLAGVFSRIIGEKIKGREWYEQKFLPAISPFALIGLLYTIVLLFSLQGDQIVSQPWAVVRLAIPLVIYFVGMFFISLIASKLSGMNYAKSASVSFTAAGNNFELAIAVSIGTFGATSAQAMAGTIGPLIEIPVLVGLVYAMLWLGPKLFPNDPTLPSSARSTSQIINS

SEQ ID NO: 123 - DNA, 762 bp, Corynebacterium glutamicum
  CDS (101)..(739): RXA02202
cgctgaactaacccaaaacgcatagcagttttctaatctcacacatcttcaacaccgttaaatctattggtttccccgtaaaatcttcgaaaggaagaacatgaccgggcaagctgcaccaaacttgcataccaatattttgaaccgtatcgcaaatgaactggcgttgacctatcaaggagttttctctgcagagactatcaaccgctatatttttgaatcgtatgtgtcgttggcgagaacagcaaaaatccatacgcacctgccaattttggcagaaggttttgctaaagaccggctgcacgcacttgcggtagctgaaggtaaggtggcttcacctgtgcctcaggtcctatttatttgcgtccacaacgcaggtcgttcacaaattgcttcggcgttgttgtctcactatgccggtagttctgtagaggtacgttctgcaggttctttacctgcttctgaaattcacccactggtgttggaaattttgtcagagcgaggagtgaacatttctgatgcatttccgaaaccgctaaccgatgatgttattcgcgcatctgactatgtcataacaatgggatgtggagatgtgtgcccaatgtatccaggaaagcactatctcgattgggagctcgctgatccgtcagatgaaggtgaggacaagatacaggaaataattgaggaaattgacggtcgaatccgcgagctttggaaaagcattcaattatcgcaaaactaggcagtcaaaggtctggcacc

SEQ ID NO: 124 - protein, 213 aa, Corynebacterium glutamicum
MTGQAAPNLHTNILNRIANELALTYQGVFSAETINRYIFESYVSLARTAKIHTHLPILAEGFAKDRLHALAVAEGKVASPVPQVLFICVHNAGRSQIASALLSHYAGSSVEVRSAGSLPASEIHPLVLEILSERGVNISDAFPKPLTDDVIRASDYVITMGCGDVCPMYPGKHYLDWELADPSDEGEDKIQEIIEEIDGRIRELWKSIQLSQN

SEQ ID NO: 125 - DNA, 1002 bp, Corynebacterium glutamicum
  CDS (101)..(979): RXA02205
gcccaaaccgagcctggatacccgcaaaccacttgaaccgaccattcgctgtttcacgcccaccacactactgaggtcataaggtagtacggtagatcgggtgaatgaagagataaccctcctagccgcagcagcagatcctgccgcaactgaaaatattggctgggtacaaaccattgtgctctccatcgttcaaggcctcacagagttcctgccgatcagctccagcggacacctccgaatcatctctgagctgttctggggtgccgatgccggcgcgtcctttaccgccgtggttcagcttggtaccgaagccgcagtgctggtgttttttgccaaggaaatctggcaaatcatcacaggttggttcgctggcgtattcaataaggaacgccgcggatttgaataccgcatgggctggatgatcattgttgccaccattcccgtcgtgatcttgggtgtgttgggcaaggacctgatccgtgaggcgctgcgaaatatgtggatcactgcatccgtgctgatcctgttctccctggtgttcattttggccgagaagatgggcaagaaggaacgcgactacgacaaactgaccatgaaagatgccatcatcatgggtcttgcacagtgtcttgcgctgatccctggcgtgtctcgctccggcggcaccatctctgctggtttgttccttggtctcaagcgtgaagtagccaccaagttctccttcctgctggcaatccctgcagtgcttggctccggtttgtactccctgcctgacgcttttgcgccaagctccggacaagctgcctccggcctacagctcaccgtgggtaccctggttgccttcgtagttggctacatttccattgcgtggctgatgaagttcgtggcaaaccactccttcagctggtttgctgcataccgtattcctgcaggtctgctcgtgatgctgctgctcgcactgggcatgctcaacccataaaattcctgtacatcttaaaa

SEQ ID NO: 126 - protein, 293 aa, Corynebacterium glutamicum
VNEEITLLAAAADPAATENIGWVQTIVLSIVQGLTEFLPISSSGHLRIISELFWGADAGASFTAVVQLGTEAAVLVFFAKEIWQIITGWFAGVFNKERRGFEYRMGWMIIVATIPVVILGVLGKDLIREALRNMWITASVLILFSLVFILAEKMGKKERDYDKLTMKDAIIMGLAQCLALIPGVSRSGGTISAGLFLGLKREVATKFSFLLAIPAVLGSGLYSLPDAFAPSSGQAASGLQLTVGTLVAFVVGYISIAWLMKFVANHSFSWFAAYRIPAGLLVMLLLALGMLNP

SEQ ID NO: 127 - DNA, 975 bp, Corynebacterium glutamicum
  CDS (101)..(952): RXA00900
gtgcggtggctgcgctggtcgctagtgtggtgtgcgcgctggcgccgtcgataagcgtattagtgatcgcacgcctggtgcaggggcttggcggcggtgcgtgcgtggtattgcgcgcgcgatcgtgccagaccttgaacgcggacaaaaggctgcgcacgcctttgcactgctgatgattattcagggaattgctcccgtggtagctccgctcattggtggtgtgctggtcgggccttttggctggcggggaattttctgggcacttgcactggtgaattttgcgcagctgcttgttgctttgctgcagattaaggagtcgaagccagttgaagagcgtaccgcagcaggacttggcggaatgctgtccaactatgtctttgtgctgaagaatcctcaatttttggcatatgtattcacattggggctgtcttttggggcgatgttctcctacatttcggcgtcgccgttcgtgctgcagaatcaaatgggcattccggtactgctgtattccattattttcggagtgaatgcttttggtttgattgtgggcggaatggtcaataggcgacttctgcagcggattcatccacaccgcatcatgcaaactgtgctggccagttttactgtgctgtgtgcgcttttgctgattgaagtgctgtttattaattggataccgctgttcctgttgctgctgtttcttatcgtttcccatattccgatggttatggctaacgcgacagctctgggaactgaagtggtgcgaagcagggcgggatcgggttctgcaattttgggtttcgtgcaattcacgatgggtgctttggtgagttcactggtcggattaggctctgataaggctttgactatgggaatcgcaatgactgcttgtgcactgctggcgtgtgggtgtgcgtacctggcaggtcgaaaaggtattccagaaatgaagtagctctaggtggcgttttaagg

SEQ ID NO: 128 - protein, 284 aa, Corynebacterium glutamicum
VRGIARAIVPDLERGQKAAHAFALLMIIQGIAPVVAPLIGGVLVGPFGWRGIFWALALVNFAQLLVALLQIKESKPVEERTAAGLGGMLSNYVFVLKNPQFLAYVFTLGLSFGAMFSYISASPFVLQNQMGIPVLLYSIIFGVNAFGLIVGGMVNRRLLQRIHPHRIMQTVLASFTVLCALLLIEVLFINWIPLFLLLLFLIVSHIPMVMANATALGTEVVRSRAGSGSAILGFVQFTMGALVSSLVGLGSDKALTMGIAMTACALLACGCAYLAGRKGIPEMK

SEQ ID NO: 129 - DNA, 537 bp, Corynebacterium glutamicum
  CDS (101)..(514): RXN00901
ttttaagtattggtgctatcttccggtgctgatggtacctgaatgaaaatttctaattaaaaatacccccaaatcttcgatatagatacacgagacagtgatgcagaaaaaacaacagctgagcaccgccctgattatgggattggcattattgtcagccagctccgcgctagcgactgatatgtatttgccggcaatgcctggtattgcggaagatttggggacaactgcaccgatggtgcagttaactctttcttcctttatggctggaatggcgattggccaattgatcattggtcctttgtcggatcaattgggaaggaaaggcctgctcgttgcaggtgcggtggctgcgctggtcgctagtgtggtgtgcgcgctggcgccgtcgataagcgtattagtgatcgcacgcctggtgcaggggcttggcggcggtgcgtgcgtggtattgcgcgcgcgatcgtgccagaccttgaacgcggacaaaaggctgcgcacgcctttgcactgctgatgattattcagggaattgct

SEQ ID NO: 130 - protein, 138 aa, Corynebacterium glutamicum
MQKKQQLSTALIMGLALLSASSALATDMYLPAMPGIAEDLGTTAPMVQLTLSSFMAGMAIGQLIIGPLSDQLGRKGLLVAGAVAALVASVVCALAPSISVLVIARLVQGLGGGACVVLRARSCQTLNADKRLRTPLHC

SEQ ID NO: 131 - DNA, 501 bp, Corynebacterium glutamicum
  CDS (101)..(478): FRXA00901
acctgaatgaaaatttctaattaaaaatacccccaaatcttcgatatagatacacgagacagtgatgcagaaaaaacaacagctgagcaccgccctgattatgggattggcattattgtcagccagctccgcgctagcgactgatatgtatttgccggcaatgcctggtattgcggaagatttggggacaactgcaccgatggtgcagttaactctttcttcctttatggctggaatggcgattggccaattgatcattggtcctttgtcggatcaattgggaaggaaaggcctgctcgttgcaggtgcggtggctgcgctggtcgctagtgtggtgtgcgcgctggcgccgtcgataagcgtattagtgatcgcacgcctggtgcaggggcttggcggcggtgcgtgcgtggtattgcgcgcgcgatcgtgccagaccttgaacgcggacaaaaggctgcgcacgcctttgcactgctgatgattattcagggaattgct

SEQ ID NO: 132 - protein, 126 aa, Corynebacterium glutamicum
MGLALLSASSALATDMYLPAMPGIAEDLGTTAPMVQLTLSSFMAGMAIGQLIIGPLSDQLGRKGLLVAGAVAALVASVVCALAPSISVLVIARLVQGLGGGACVVLRARSCQTLNADKRLRTPLHC

SEQ ID NO: 133 - DNA, 1299 bp, Corynebacterium glutamicum
  CDS (101)..(1276): RXA00289
cctccccataagttcactcaagcaagttctcccgaacagattcacccgagaagtcgacagaccccattaaacagcccgattcaagaaaggcttcgcagccatgagcaccaccaccgcgcccgaagcacggtttcctgtcgtccctttgaccgccatgagtttcgcggcatttgtttatgtcacgttcgagatgtttgcagttggcctcatcaagccgatggccagcgatcttggagtgtcagaatccagcatcggcctgttgatgactgtgtatgcgactgtcgttgccgtggtgacgatccctgccatgttgtgggtttctcgatttaacaagcgcacagttttcctgattactctggcatttttggccacgggcattgttgttcaggcactgaccgttaattatggaatgctagccatcggccgcactatcgcagcattgactcacggggtgttttgggcacttgttgggccaatggcagcgcgtatgtccccaggtcacactggtcgtgcagtaggcgttgtgtcgattggatcaaccatggcgctggtcgttggttctccgctggcaacatggatcggtgaactcatcggatggcgtcctgccacctggattcttggtgcgctgaccattgcggccgtggctgtactcattccaaccgttccatcactgccaccacttccagacacggaatcagagtccaaagaaaagaaatcccttccatggggtctcatttccctggtcattttccttctccttgccgtcaccggtgtttttgctgcctacacctaccttggcctcatcatcgctgaaacagcaggggacagcttcgtgtccattggcttgttcgccttcggtgcactcggactcattggcgtgacagtggcaacccgaactgtggatcaacgcatgctgcgtggaagtgttcacaccaccactttgtttgtcattgctgcaattctcggacagatcgcattcggattagagggcacactagccgtagtagctatcttccttgcagtcaccgtgtttggtggagcatacggcgctctcccaaccctgggaaccaccatcttcctccatgcgggtcgcgaccacccagatactgcatcctccatttatgtggtcacttaccaagtgggtatcgcgtctggcgcggcacttggcgcgatggctgtggatgccgattgggttgctggcactttgtggatcatggctggactgtcattggcttccacgttggccttggcgctgtggtcccgcccgctactgaagtagcagcccaaattcagcccact

SEQ ID NO: 134 - protein, 392 aa, Corynebacterium glutamicum
MSTTTAPEARFPVVPLTAMSFAAFVYVTFEMFAVGLIKPMASDLGVSESSIGLLMTVYATVVAVVTIPAMLWVSRFNKRTVFLITLAFLATGIVVQALTVNYGMLAIGRTIAALTHGVFWALVGPMAARMSPGHTGRAVGVVSIGSTMALVVGSPLATWIGELIGWRPATWILGALTIAAVAVLIPTVPSLPPLPDTESESKEKKSLPWGLISLVIFLLLAVTGVFAAYTYLGLIIAETAGDSFVSIGLFAFGALGLIGVTVATRTVDQRMLRGSVHTTTLFVIAAILGQIAFGLEGTLAVVAIFLAVTVFGGAYGALPTLGTTIFLHAGRDHPDTASSIYVVTYQVGIASGAALGAMAVDADWVAGTLWIMAGLSLASTLALALWSRPLLK

SEQ ID NO: 135 - DNA, 420 bp, Corynebacterium glutamicum
  CDS (101)..(397): RXN01984
aggaaatgtctcacgtcacaaccttttgaaaggtggctaagtacgcacatttgttgtctgcaatagtgccggtgagggagctgtccgatattgtgcttacatgcacgaatctggaaaaaatcctgtcaaggttgtcgactcgcaggcaccacaaggacgcggtgggcatatcggcggacatatcaaacgccgcccgattcctaggcaaacggaaatttccgaggttcgtcgatatatcgtcatgactgccctcgcactcggtggcttcgccatcggtgtgacggaatttgtctccatgggtctgctcagcgcgatcgcctccgactttgagatctccgaagaccaagccggacacatcatcaccatctacgccctcgcgtggttgtgggtgccccgctgatcacagcgtttaccggcaaa

SEQ ID NO: 136 - protein, 99 aa, Corynebacterium glutamicum
MHESGKNPVKVVDSQAPQGRGGHIGGHIKRRPIPRQTEISEVRRYIVMTALALGGFAIGVTEFVSMGLLSAIASDFEISEDQAGHIITIYALAWLWVPR

SEQ ID NO: 137 - DNA, 379 bp, Corynebacterium glutamicum
  CDS (101)..(379): FRXA01984
aggaaatgtctcacgtcacaaccttttgaaaggtggctaagtacgcacatttgttgtctgcaatagtgccggtgagggagctgtccgatattgtgcttacatgcacgaatctggaaaaaatcctgtcaaggttgtcgactcgcaggcaccacaaggacgcggtgggcatatcggcggacatatcaaacgccgcccgattcctaggcaaacggaaatttccgaggttcgtcgatatatcgtcatgactgccctcgcactcggtggcttcgccatcggtgtgacggaatttgtctccatgggtctgctcagcgcgatcgcctccgactttgagatctccgaagaccaagccggacacatcatcaccatctacgccctcgcg

SEQ ID NO: 138 - protein, 93 aa, Corynebacterium glutamicum
MHESGKNPVKVVDSQAPQGRGGHIGGHIKRRPIPRQTEISEVRRYIVMTALALGGFAIGVTEFVSMGLLSAIASDFEISEDQAGHIITIYALA

SEQ ID NO: 139 - DNA, 735 bp, Corynebacterium glutamicum
  CDS (101)..(712): RXA00109
aagtgggggaagatttcgacaactaaccgggcgcaaagatgaaactaatgcgtccgaccacggcgaaaaggaagtttcgcccatctatgagaggttgaatgtggcttcagagaagaatctaaaattgcgtaccttggcggcagctgctggggtgttgggcgttggcgcgatgtcgatgctcgtggctccgcaggctgctgcccatgatgtggtggtggattctaatcctgaaaatggcagtgtcgttgatgagttcccggagaccattgagttggagttttccggtattcctcaggatctgttcacaacagttgcattgagcaatgcggattccggagaggtgttaacttctggaactcctcagcttgaggggcagcacttgagctatgaagtgccatctgatgtgcagacgggagctggtaactacattttgggtttccagatcacttcttctgatggtcacgctactaaaggttcaatctcttttgaggtgacaggctctgctgaaacgacaacagagacaacagcagagacgacaactgagtcagcagcaaccactgacacctcagagaccaccgaagcagagacaactgaaactgctgatgaaacttctggaattcctgcgccgtggaattgggttttgagcatcgtggcggtgcttgttgttgcaagtgccatcgtcatgatgattgcaaagaatcgtaaccagaaataagagggtttattcaccatgaa

SEQ ID NO: 140 - protein, 204 aa, Corynebacterium glutamicum
VASEKNLKLRTLAAAAGVLGVGAMSMLVAPQAAAHDVVVDSNPENGSVVDEFPETIELEFSGIPQDLFTTVALSNADSGEVLTSGTPQLEGQHLSYEVPSDVQTGAGNYILGFQITSSDGHATKGSISFEVTGSAETTTETTAETTTESAATTDTSETTEAETTETADETSGIPAPWNWVLSIVAVLVVASAIVMMIAKNRNQK

SEQ ID NO: 141 - DNA, 735 bp, Corynebacterium glutamicum; identical to SEQ ID NO: 139
  CDS (101)..(712): RXA00109

SEQ ID NO: 142 - protein, 204 aa, Corynebacterium glutamicum; identical to SEQ ID NO: 140

SEQ ID NO: 143 - DNA, 864 bp, Corynebacterium glutamicum
  CDS (101)..(841): RXA00996
atcttaagccttttgtccaaggctctgagttcttagtggcggtatttaccaagaagtaacacctctatcttgcacctgatctggcgtagactcataagttatgagcaccgtaacggcagtgcaggtcaacggcctaaaagtttccatatcgtccggtttttcacgcaagaaaacaaaaacgatcttgcatgatctcgatttcaccgtagagaccggaaagatcacgggattgctggggccatcgggcagcggcaagacaactttgatgcgcgcgattgtgggagtgcaaaacttcgacggcacccttgaggtgtttgatcagcccgcaggtgctgcctctctgcgcgggaaaatcggctatgtcacccaaaacgccagcgtatatcacgatctgtcggtgatagaaaacctcaagtatttcggggctctggctaaaggaacctccactccacgcaccccggaaaagattctggaggtcttagacatcgcagatcttgctcaacgccaagtatcaacactatctggtgggcagcgcggccgagtctcccttggatgtgcgcttattgcctcaccagaactcttggtgatggatgagccaaccgtgggtttggatcccattacccggcaagcactgtgggaagagttcaccaccatcgcaaaagcaggtgctggagtggttatctccagtcacgtgttggaggaagccgcgcggtgcgacaacctcattttgttgcgtgatggtcggatcatctggaggggaacacccacacgccttctagaagatacaggcaaaagctcatacgaagatgctttcttggctgccattgacggggtaaggtcatgaaccctcactatctgcttgcc

SEQ ID NO: 144 - protein, 247 aa, Corynebacterium glutamicum
MSTVTAVQVNGLKVSISSGFSRKKTKTILHDLDFTVETGKITGLLGPSGSGKTTLMRAIVGVQNFDGTLEVFDQPAGAASLRGKIGYVTQNASVYHDLSVIENLKYFGALAKGTSTPRTPEKILEVLDIADLAQRQVSTLSGGQRGRVSLGCALIASPELLVMDEPTVGLDPITRQALWEEFTTIAKAGAGVVISSHVLEEAARCDNLILLRDGRIIWRGTPTRLLEDTGKSSYEDAFLAAIDGVRS

SEQ ID NO: 145 - DNA, 2463 bp, Corynebacterium glutamicum
  CDS (101)..(2440): RXN00829
tgttttagccatggaccccatactagggagagttttgttttggtgctagaaaaggttcaccaagcgcgaacaggcctatgcaaacggtacgatatgacacatgcaaaaagctgattcccatgattggatttcggtccacggtgcgaatgaaaacaacctcaaaaatgtgtcggtgcgcatccctaaaaggcgtctcaccgtgttcacgggtgtgtcgggatctggcaagtcctcgctggtgttcggcacaattgctgcggaatcacgccggttgatcaacgaaacctatagcacttttgtgcaaggtttcatgccgtcgatggcaaggcccgatgttgaccatttggaaggcatcaccacggcgatcatcgtcgatcaggagcagatgggcgcaaacccacggtctacggtgggtaccgcaactgatgccaccgcgatgttgcgcattttgttttcccgaatcgcggaacctaacgcgggtggcccgggagcttattccttcaacgtcccctctgtttccgcatccggcgccatcacggtggaaaagggcggaaacaccaagcgggagaaagctaccttcaaacgcacgggtggcatgtgcccagcgtgcgagggcatgggcagggcctcagacatcgacctcaaagagcttttcgacgcctccctctccctcaacgacggcgccctgaccatccccggttacaccccaggtggatggagttatcggatgtattcagaatcgggcctttttgatgctgccaagccgattaaggatttcaccgaggaagaacgccacaacttcctttatcttgagcccaccaagatgaagatcgctggcatcaacatgacctatgagggtcttatcccccgcattcagaaatccatgttgtctaaggatcgcgaaggcatgcagaagcatattcgtgcgttcgtggatcgagcggttaccttcattccttgccctgcgtgtggtggaactcgattagcgccacatgccttggagtccaagatcaatggcaaaaacatcgctgagttgtgcgcgatggaggtccgtgatttggccaagtggatcaaaacggtggaagccccctcggttgctcccctgctcaccgcactgactgaaaccctggataacttcgtggagatcggtttgggctatatccaactcgatcgccccgctggcacgttgtctggtggtgaggcacagcgcaccaagatgatccgccatttgggctctgcattgactgacgtcacctatgtttttgatgaacccaccgccggtttgcacgcctacgacattgaacgcatgaacaagttgctgctcgatcttcgcgataaaggcaataccgttttagtcgtggagcacaagccggaaaccatcgccattgcagatcatgtggtggaccttgggccaggtgcaggcgcgggtggaggtgaaattcggtttgaggggagcgtcgacaagcttaaagacagcgacaccgtgactggcctccattttaatgaccgggcgtcattgaaggaatccgtgcgtgcgccgcatggcgccctggagatccgcggggccgatcgaaataatttgaacaatgtggatgtcgatattccgctcggcgtgttcacggcgatttccggcgttgcaggttcgggtaagtcctcgttgattcatgagattccgcgtgatgagtcggttgtgtttgtcgatcaaaccgcaatccacggttctaatcgttccaatcctgcgacatatacaggcatgctggattcgattcgcaaggcttttgccaaggccaatgatgtgaaaccggcgctgttctcccccaattctgaaggcgcgtgcccaaactgtaagggcgccggctcggtctatgtcgatttgggcatgatggctggggtatcttcgccgtgtgaggtgtgcgagggcaagcgttttgatgagtccgtgttggactaccactttggtggcaaggacatcgcagacgtgttggggctgtcggctgccaatgcgtatgagtttttcgcggcgaaagattcaaagattttgcctgcggcaaagatcgcaaagaggcttgtcgacgtcggcctcggctacatcaccctcggccagccgctcaccacgttgtccggcggtgaacgccagcgtttgaagctcgccacccacatggcagacaaggccaccacctttattttggatgagcccaccacaggcctgcacctcgctgatgtgaaaaccttgctggatctttttgatcaactggttgatgacggcaagtctgtcatcgtcatcgaacaccacctcggcgtgctcgctcacgctgaccacatcattgatgtcggccctggtgcaggttctgatggtggctcgattgtattcgagggcagccccgcggaactcatcaaaactgatactccaacaggacgccaccttaaagcttatgtagattagtttcttatggaaaaccctgg

SEQ ID NO: 146 - protein, 780 aa, Corynebacterium glutamicum
MQKADSHDWISVHGANENNLKNVSVRIPKRRLTVFTGVSGSGKSSLVFGTIAAESRRLINETYSTFVQGFMPSMARPDVDHLEGITTAIIVDQEQMGANPRSTVGTATDATAMLRILFSRIAEPNAGGPGAYSFNVPSVSASGAITVEKGGNTKREKATFKRTGGMCPACEGMGRASDIDLKELFDASLSLNDGALTIPGYTPGGWSYRMYSESGLFDAAKPIKDFTEEERHNFLYLEPTKMKIAGINMTYEGLIPRIQKSMLSKDREGMQKHIRAFVDRAVTFIPCPACGGTRLAPHALESKINGKNIAELCAMEVRDLAKWIKTVEAPSVAPLLTALTETLDNFVEIGLGYIQLDRPAGTLSGGEAQRTKMIRHLGSALTDVTYVFDEPTAGLHAYDIERMNKLLLDLRDKGNTVLVVEHKPETIAIADHVVDLGPGAGAGGGEIRFEGSVDKLKDSDTVTGLHFNDRASLKESVRAPHGALEIRGADRNNLNNVDVDIPLGVFTAISGVAGSGKSSLIHEIPRDESVVFVDQTAIHGSNRSNPATYTGMLDSIRKAFAKANDVKPALFSPNSEGACPNCKGAGSVYVDLGMMAGVSSPCEVCEGKRFDESVLDYHFGGKDIADVLGLSAANAYEFFAAKDSKILPAAKIAKRLVDVGLGYITLGQPLTTLSGGERQRLKLATHMADKATTFILDEPTTGLHLADVKTLLDLFDQLVDDGKSVIVIEHHLGVLAHADHIIDVGPGAGSDGGSIVFEGSPAELIKTDTPTGRHLKAYVD

SEQ ID NO: 147 - DNA, 278 bp, Corynebacterium glutamicum
  CDS (1)..(255): FRXA00829
ttggatgagcccaccacaggcctgcacctcgctgatgtgaaaaccttgctggatctttttgatcaactggttgatgacggcaagtctgtcatcgtcatcgaacaccacctcggcgtgctcgctcacgctgaccacatcattgatgtcggccctggtgcaggttctgatggtggctcgattgtattcgagggcagccccgcggaactcatcaaaactgatactccaacaggacgccaccttaaagcttatgtagattagtttcttatggaaaaccctgg

SEQ ID NO: 148 - protein, 85 aa, Corynebacterium glutamicum
LDEPTTGLHLADVKTLLDLFDQLVDDGKSVIVIEHHLGVLAHADHIIDVGPGAGSDGGSIVFEGSPAELIKTDTPTGRHLKAYVD

SEQ ID NO: 149 - DNA, 1663 bp, Corynebacterium glutamicum
  CDS (101)..(1663): FRXA00834
tgttttagccatggaccccatactagggagagttttgttttggtgctagaaaaggttcaccaagcgcgaacaggcctatgcaaacggtacgatatgacacatgcaaaaagctgattcccatgattggatttcggtccacggtgcgaatgaaaacaacctcaaaaatgtgtcggtgcgcatccctaaaaggcgtctcaccgtgttcacgggtgtgtcgggatctggcaagtcctcgctggtgttcggcacaattgctgcggaatcacgccggttgatcaacgaaacctatagcacttttgtgcaaggtttcatgccgtcgatggcaaggcccgatgttgaccatttggaaggcatcaccacggcgatcatcgtcgatcaggagcagatgggcgcaaacccacggtctacggtgggtaccgcaactgatgccaccgcgatgttgcgcattttgttttcccgaatcgcggaacctaacgcgggtggcccgggagcttattccttcaacgtcccctctgtttccgcatccggcgccatcacggtggaaaagggcggaaacaccaagcgggagaaagctaccttcaaacgcacgggtggcatgtgcccagcgtgcgagggcatgggcagggcctcagacatcgacctcaaagagcttttcgacgcctccctctccctcaacgacggcgccctgaccatccccggttacaccccaggtggatggagttatcggatgtattcagaatcgggcctttttgatgctgccaagccgattaaggatttcaccgaggaagaacgccacaacttcctttatcttgagcccaccaagatgaagatcgctggcatcaacatgacctatgagggtcttatcccccgcattcagaaatccatgttgtctaaggatcgcgaaggcatgcagaagcatattcgtgcgttcgtggatcgagcggttaccttcattccttgccctgcgtgtggtggaactcgattagcgccacatgccttggagtccaagatcaatggcaaaaacatcgctgagttgtgcgcgatggaggtccgtgatttggccaagtggatcaaaacggtggaagccccctcggttgctcccctgctcaccgcactgactgaaaccctggataacttcgtggagatcggtttgggctatatccaactcgatcgccccgctggcacgttgtctggtggtgaggcacagcgcaccaagatgatccgccatttgggctctgcattgactgacgtcacctatgtttttgatgaacccaccgccggtttgcacgcctacgacattgaacgcatgaacaagttgctgctcgatcttcgcgataaaggcaataccgttttagtcgtggagcacaagccggaaaccatcgccattgcagatcatgtggtggaccttgggccaggtgcaggcgcgggtggaggtgaaattcggtttgaggggagcgtcgacaagcttaaagacagcgacaccgtgactggcctccattttaatgaccgggcgtcattgaaggaatccgtgcgtgcgccgcatggcgccctggagatccgcggggccgatcgaaataatttgaacaatgtggatgtcgatattccgctcggcgtgttcacggcgatttccggcgttgcaggttcgggtaagtcctcgttgatt

SEQ ID NO: 150 - protein, 521 aa, Corynebacterium glutamicum
MQKADSHDWISVHGANENNLKNVSVRIPKRRLTVFTGVSGSGKSSLVFGTIAAESRRLINETYSTFVQGFMPSMARPDVDHLEGITTAIIVDQEQMGANPRSTVGTATDATAMLRILFSRIAEPNAGGPGAYSFNVPSVSASGAITVEKGGNTKREKATFKRTGGMCPACEGMGRASDIDLKELFDASLSLNDGALTIPGYTPGGWSYRMYSESGLFDAAKPIKDFTEEERHNFLYLEPTKMKIAGINMTYEGLIPRIQKSMLSKDREGMQKHIRAFVDRAVTFIPCPACGGTRLAPHALESKINGKNIAELCAMEVRDLAKWIKTVEAPSVAPLLTALTETLDNFVEIGLGYIQLDRPAGTLSGGEAQRTKMIRHLGSALTDVTYVFDEPTAGLHAYDIERMNKLLLDLRDKGNTVLVVEHKPETIAIADHVVDLGPGAGAGGGEIRFEGSVDKLKDSDTVTGLHFNDRASLKESVRAPHGALEIRGADRNNLNNVDVDIPLGVFTAISGVAGSGKSSLI

SEQ ID NO: 151 - DNA, 864 bp, Corynebacterium glutamicum
  CDS (101)..(841): RXA00995
gtcggatcatctggaggggaacacccacacgccttctagaagatacaggcaaaagctcatacgaagatgctttcttggctgccattgacggggtaaggtcatgaaccctcactatctgcttgccacggtcaaacgagtcctgctgcagctgaaagccgataaacgttccatcgcgctgattcttctagcacccgtggcgttgatgtcgctgttttattacatgtattcctccacaccggcaggcacccagctgtttaagaccatttccacggtcatgatcgcagtgttccccttgatgctcatgtttttgatgacgtcggtgacgatgcaaagagaacgcaacgctggaacgctcgagcgcttgtggaccacgaacattcaccgcgttgatttgatcggtggctacggggtggccttcggcatcatggcggtggcgcaatctttgctcatggtgctcacccttcggtatctcctgggtgtggaaaccgaatcggagtggtggatttctacgctcattgctgcgatcaccggtcttatcggagtgtctcttggcctgttgagctctgcgtttgccagcactgagttccaagctatccaaacgctgccgttgcttattttgccccagttcctattgtgcggtttgctgatcccacgggatgatctgccggatgtgttgcgctgggtttctaatgtgttgccgctgtcctatgcagttgatgcagcgcttgaggcctcacggacgggaatcggacagcaagtagtggtcaacattgccatctgcgccgcgtttgccgtgagcttcctgctggtggcggcgctatcgatgccgagaatgacccgctagattactcttccagcgaggtg

SEQ ID NO: 152 - protein, 247 aa, Corynebacterium glutamicum
MNPHYLLATVKRVLLQLKADKRSIALILLAPVALMSLFYYMYSSTPAGTQLFKTISTVMIAVFPLMLMFLMTSVTMQRERNAGTLERLWTTNIHRVDLIGGYGVAFGIMAVAQSLLMVLTLRYLLGVETESEWWISTLIAAITGLIGVSLGLLSSAFASTEFQAIQTLPLLILPQFLLCGLLIPRDDLPDVLRWVSNVLPLSYAVDAALEASRTGIGQQVVVNIAICAAFAVSFLLVAALSMPRMTR

SEQ ID NO: 153 - DNA, 1353 bp, Corynebacterium glutamicum
  CDS (101)..(1330): RXN00803
tcatccttccttagctcgcgtgagcttcccaagcgtaagcacccccgtgtgagggcataacggccgttctgttaaagattggtctggccatttcctccatatgggggtgtccgcgcttaacatgtctgacatggtggcgaacaaacgggcacagcgtaaagtctggctagcggtagctttatcggtctttacggtcgcgtggggtggcaatgaattcactcccttgctggtgttttaccgaggtgaagggttctttagcaacctgttcatcgaccttttgctggtgttttatgccatcggagtagcggtaggtttgctggcagctggtcctttatctgaccgctatggccgacgtgccgtcatgttgcctgcgccattgatcgcgatcttgggttccgcgttgattgcctcgggtgaagaaaccgccatcctgattgccattggtcgagtgctgtcgggaatttcggtgggcatggtgatgacagcgggaggttcctggattaaggagctttcatcgtcgcggtttgagccaggggtgaaaaccagtgctggtgcaaaacgcgcatcgatgtctttgaccggtggttttgcgctcggcccagcgcttgctggtgtgatggcacagtggctgccactacctggacagttggcatatgttttgcacattattctcactctgattttgttcccgttgcttattacagcgccggaaactcgtcaatcagcgcacctgaaaactaagggatcattctggtcagatgtgcttgtgccatctgcactagacaagcgattcttgtttgtggttgctccaattggaccgtgggttttcggtgcggccttcactgcctacgcagttttgccgtcgcagctgcgtgacatggtttctgcacccgttgcgtattctgcgctgatcgctttggttaccttaggttctggatttggtatccaacaattcggtcctcaaatcatgggcacctctaaaactcgcgggccgattttggccatgttcgtcacagtcatcggcatgatcggcgcggtgatcgtggtgatgaaccctcatccatggtgggcgctagttggctgcatggccctcggcctgtcttatggcctgtgtatgttcatggggttggcggaaactcaaaacattgctccacctattgatatggcaggcctgacgggtattttctactgcctgacgtacgtaggtatggtctttccagccttgatgacctggttgaatcaatggctcagttacccgttcatgctgggctttggtgcggtgatggcaactatttgtctgatcattgtgagttttagtgcacgccgattctgagaaacaactaaagtgagcca

SEQ ID NO: 154 - protein, 410 aa, Corynebacterium glutamicum
MGVSALNMSDMVANKRAQRKVWLAVALSVFTVAWGGNEFTPLLVFYRGEGFFSNLFIDLLLVFYAIGVAVGLLAAGPLSDRYGRRAVMLPAPLIAILGSALIASGEETAILIAIGRVLSGISVGMVMTAGGSWIKELSSSRFEPGVKTSAGAKRASMSLTGGFALGPALAGVMAQWLPLPGQLAYVLHIILTLILFPLLITAPETRQSAHLKTKGSFWSDVLVPSALDKRFLFVVAPIGPWVFGAAFTAYAVLPSQLRDMVSAPVAYSALIALVTLGSGFGIQQFGPQIMGTSKTRGPILAMFVTVIGMIGAVIVVMNPHPWWALVGCMALGLSYGLCMFMGLAETQNIAPPIDMAGLTGIFYCLTYVGMVFPALMTWLNQWLSYPFMLGFGAVMATICLIIVSFSARRF

SEQ ID NO: 155 - DNA, 703 bp, Corynebacterium glutamicum
  CDS (101)..(703): FRXA00803
tcatccttccttagctcgcgtgagcttcccaagcgtaagcacccccgtgtgagggcataacggccgttctgttaaagattggtctggccatttcctccatatgggggtgtccgcgcttaacatgtctgacatggtggcgaacaaacgggcacagcgtaaagtctggctagcggtagctttatcggtctttacggtcgcgtggggtggcaatgaattcactcccttgctggtgttttaccgaggtgaagggttctttagcaacctgttcatcgaccttttgctggtgttttatgccatcggagtagcggtaggtttgctggcagctggtcctttatctgaccgctatggccgacgtgccgtcatgttgcctgcgccattgatcgcgatcttgggttccgcgttgattgcctcgggtgaagaaaccgccatcctgattgccattggtcgagtgctgtcgggaatttcggtgggcatggtgatgacagcgggaggttcctggattaaggagctttcatcgtcgcggtttgagccaggggtgaaaaccagtgctggtgcaaaacgcgcatcgatgtctttgaccggtggttttgcgctcggcccagcgcttgctggtgtgatggcacagtggctgccacaacctggacagttggcatatgttttgcacattattctcactctgattttgttcccgttgcttattaca

SEQ ID NO: 156 - protein, 201 aa, Corynebacterium glutamicum
MGVSALNMSDMVANKRAQRKVWLAVALSVFTVAWGGNEFTPLLVFYRGEGFFSNLFIDLLLVFYAIGVAVGLLAAGPLSDRYGRRAVMLPAPLIAILGSALIASGEETAILIAIGRVLSGISVGMVMTAGGSWIKELSSSRFEPGVKTSAGAKRASMSLTGGFALGPALAGVMAQWLPQPGQLAYVLHIILTLILFPLLIT

SEQ ID NO: 157 - DNA, 1014 bp, Corynebacterium glutamicum
  CDS (101)..(991): RXA01407
atccggggaacggatcccaaagatctccttgatgccatcgcgtttttaacctggccagctctggttgccccagtgatcgccccacttctgggaggtcttcttgcaagataccattggttgccgatggatcttcctcctcaacgtgcccttaggaatcatcgcgatcatggctggactattcatccagcccaagaacacggccgtgaatgtgaagcgatttgatcggccaggtttcctcggcgcaatgctggtgatggtggcgcaagccgtgattgcggagttaatttgcagcagaagtccggccgcacttactatctgtgcatgcctcgtcttaagtgctgcggtggtatgcggttttgtagtgcgctggctgcgagttccaggccgactttttgatctcagcatcatgcgcatcccaggtttccgagtgggtaattcctccggaagtatctaccgcttggtaatcaccgcagcaccattcatgttcactttgctcttccaagtggcgtttgggtggtctgcaacattagcgggtgccatggtggtcgcactattcgcaggcaacgtggcaatcaaacctttcaccacgccgatcattaaacgctggaatttcaaaccagtactggtcttttctaacgctgctggcgccttggtattggcaacttttttgttcgttcgtgcagataccccactggttctcatcgtgctgctgctctttgtttcgggcgcattaaggtccctcggtttcagcgcctacaacaccttgcagtttgtcgatatctcaccagaacaaaccagcaacgccaacgtgttatcagcaaccctgcaccaactaggcatgtctttgggtattgcggtagcagtcatcgccatgtcccttgcacccaccgccaactgggcattcccactggcagcagcgttgttcctcattcctctaatcggcgcactatctttgcctcgcgacggcggtgcccgagccttttcctcctcttagaaacccacttctgaaaggta

SEQ ID NO: 158 - protein, 297 aa, Corynebacterium glutamicum
LQDTIGCRWIFLLNVPLGIIAIMAGLFIQPKNTAVNVKRFDRPGFLGAMLVMVAQAVIAELICSRSPAALTICACLVLSAAVVCGFVVRWLRVPGRLFDLSIMRIPGFRVGNSSGSIYRLVITAAPFMFTLLFQVAFGWSATLAGAMVVALFAGNVAIKPFTTPIIKRWNFKPVLVFSNAAGALVLATFLFVRADTPLVLIVLLLFVSGALRSLGFSAYNTLQFVDISPEQTSNANVLSATLHQLGMSLGIAVAVIAMSLAPTANWAFPLAAALFLIPLIGALSLPRDGGARAFSSS

SEQ ID NO: 159 - DNA, 324 bp, Corynebacterium glutamicum
  CDS (101)..(301): RXA01408
cgcatagagttatctcgaaactaccaagacggtttcttttctttagatctaaggaggagagaccgtctttcaccctttcatctgattggacatcgacgccatgcgcaatgatcggtcctttagcgttcccattgcgctacttgccgcgggagcactgtttctagaaatcctcgacggcaccatcctgacaaccgcagtgccagctattgctcgtgacttcggtattgacgccgtggatgtcagcattgcactggttgcttacttggcagccgcagcagctggcattccgctgcagggtggctagcggatcgatttggtgtgcgc

SEQ ID NO: 160 - protein, 67 aa, Corynebacterium glutamicum
MRNDRSFSVPIALLAAGALFLEILDGTILTTAVPAIARDFGIDAVDVSIALVAYLAAAAAGIPLQGG

SEQ ID NO: 161 - DNA, 1275 bp, Corynebacterium glutamicum
  CDS (101)..(1252): RXN01922
acactcctttggtcacctggtttggttgagggaaacagaccgcccaagaacccaagaaatcccaagaaaacatgctgcttatgaattaaagtgagcacccatgagatcaggaaacgccaatcgcgtcttcataggtgttaccatcctgctgtttactgcaggatgggcagccaatcatttcgcgtcagtgttggtgttgatccgtgaacaattagacgtatcaagcgtgctggtcaacggcgcttttggtatttatgcactgggacttcttccaagtttgctcgcaggcggtgtgcttgccgaccgttttggtgcccgcatggtggtactcaccggaggtgtactttctgcgcttggaaacctttctcttttagcgtttcatgatggtccttccctcctggtaggacgattcatcgttggtctgggcgttggattagtcgtcagcgcgggcaccgcatgggcgggcagattgcgcggagcaagcggcgtgacattggccggcattattctgaccgccggtttcatgatggggccgattgtgacaagtgggttggggatggcgtcgacaagcattattacgccctttgccataagcgttgccctctcgctgatcgcggtggttgtgggatttgcgcttggcgatgcccgcagcaccccgagcgcacttggcgcatccagcggaatcaaacacgaacgaagcatgaaaaaggccctcgcggtgtccttgccgatggcaatttgggtgttcagctgcatcaccacctccctgatcgtgatgtccgcgcgcatcgactccaccttcggcaacgccattcttctccccggaatcggcgcggcgatcgccttcagcgcaggcctgatcgcacaatttttaggtaggaaattcgcgtggggtcgtggctccggaatcgtgggcgcgctgtgtgccctcgcgggttttgcgctggcagcttttggtggcgactccattccagtgtggcttttcgttatcgcctcgatcctgttcggcaccgcatatggcctctgcctgcgcgaaggcctcctcagcatcgaaacttacacgccactcaaccgacgtggcaccggcatcggcatctattatgtgttcacgtatttgggattcgggctgccagtgcttctcgacgccctcctcccgcaccttggcgcctccattccgctgtacgcgctggcggcgctcgcccttggctccgcagtaatccgcggcgtacaaatcaagcgcgggtatgtggtttagatttctacctacgacctgaa

SEQ ID NO: 162 - protein, 384 aa, Corynebacterium glutamicum
MRSGNANRVFIGVTILLFTAGWAANHFASVLVLIREQLDVSSVLVNGAFGIYALGLLPSLLAGGVLADRFGARMVVLTGGVLSALGNLSLLAFHDGPSLLVGRFIVGLGVGLVVSAGTAWAGRLRGASGVTLAGIILTAGFMMGPIVTSGLGMASTSIITPFAISVALSLIAVVVGFALGDARSTPSALGASSGIKHERSMKKALAVSLPMAIWVFSCITTSLIVMSARIDSTFGNAILLPGIGAAIAFSAGLIAQFLGRKFAWGRGSGIVGALCALAGFALAAFGGDSIPVWLFVIASILFGTAYGLCLREGLLSIETYTPLNRRGTGIGIYYVFTYLGFGLPVLLDALLPHLGASIPLYALAALALGSAVIRGVQIKRGYVV

SEQ ID NO: 163 - DNA, 1130 bp, Corynebacterium glutamicum
  CDS (1)..(1107): FRXA01922
ctgctgtttactgcaggatgggcagccaatcatttcgcgtcagtgttggtgttgatccgtgaacaattagacgtatcaagcgtgctggtcaacggcgcttttggtatttatgcactgggacttcttccaagtttgctcgcaggcggtgtgcttgccgaccgttttggtgcccgcatggtggtactcaccggaggtgtactttctgcgcttggaaacctttctcttttagcgtttcatgatggtccttccctcctggtaggacgattcatcgttggtctgggcgttggattagtcgtcagcgcgggcaccgcatgggcgggcagattgcgcggagcaagcggcgtgacattggccggcattattctgaccgccggtttcatgatggggccgattgtgacaagtgggttggggatggcgtcgacaagcattattacgccctttgccataagcgttgccctctcgctgatcgcggtggttgtgggatttgcgcttggcgatgcccgcagcaccccgagcgcacttggcgcatccagcggaatcaaacacgaacgaagcatgaaaaaggccctcgcggtgtccttgccgatggcaatttgggtgttcagctgcatcaccacctccctgatcgtgatgtccgcgcgcatcgactccaccttcggcaacgccattcttctccccggaatcggcgcggcgatcgccttcagcgcaggcctgatcgcacaatttttaggtaggaaattcgcgtggggtcgtggctccggaatcgtgggcgcgctgtgtgccctcgcgggttttgcgctggcagcttttggtggcgactccattccagtgtggcttttcgttatcgcctcgatcctgttcggcaccgcatatggcctctgcctgcgcgaaggcctcctcagcatcgaaacttacacgccactcaaccgacgtggcaccggcatcggcatctattatgtgttcacgtatttgggattcgggctgccagtgcttctcgacgccctcctcccgcaccttggcgcctccattccgctgtacgcgctggcggcgctcgcccttggctccgcagtaatccgcggcgtacaaatcaagcgcgggtatgtggtttagatttctacctacgacctgaa

SEQ ID NO: 164 - protein, 369 aa, Corynebacterium glutamicum
LLFTAGWAANHFASVLVLIREQLDVSSVLVNGAFGIYALGLLPSLLAGGVLADRFGARMVVLTGGVLSALGNLSLLAFHDGPSLLVGRFIVGLGVGLVVSAGTAWAGRLRGASGVTLAGIILTAGFMMGPIVTSGLGMASTSIITPFAISVALSLIAVVVGFALGDARSTPSALGASSGIKHERSMKKALAVSLPMAIWVFSCITTSLIVMSARIDSTFGNAILLPGIGAAIAFSAGLIAQFLGRKFAWGRGSGIVGALCALAGFALAAFGGDSIPVWLFVIASILFGTAYGLCLREGLLSIETYTPLNRRGTGIGIYYVFTYLGFGLPVLLDALLPHLGASIPLYALAALALGSAVIRGVQIKRGYVV

SEQ ID NO: 165 - DNA, 362 bp, Corynebacterium glutamicum
  CDS (1)..(339): RXA02060
gaatttgcccgcattttgaagccaaagggacaggtcatcgtgcttaccgcagataccggccacttggctgagcttcgtgaaccactgggcatcattgatgtggaggccggcaaagttgatcgcatgatcgaacaagcggcaggccacctcaagccagttggcgaaagagacttggtggaatttgaaatgctgctggatcaaaaatccattgcatctcagatcggtatgagcccttctgcacgccacattaagcctgaggctttggcggaacgcatcgccgctctaccagaacaaatgaaggttacagcccgggccaagatcaccaggctggaacgcatctaactcttatctcactgggcctt

SEQ ID NO: 166 - protein, 113 aa, Corynebacterium glutamicum
EFARILKPKGQVIVLTADTGHLAELREPLGIIDVEAGKVDRMIEQAAGHLKPVGERDLVEFEMLLDQKSIASQIGMSPSARHIKPEALAERIAALPEQMKVTARAKITRLERI

SEQ ID NO: 167 - DNA, 1395 bp, Corynebacterium glutamicum
  CDS (101)..(1372): RXN01936
gcgcggtgacaccacagccgttgtcagcggcgcttggtctgtggaggatcgccgaggttactaacaaataggcccaacaaagaggtctaagctctacctggtgagtttccgagatattttcgctgacaccagaccgctgaaagaaccggccttcaaacgcctctggcttggcaatgttgccaccgtcattggtgcccaattaactgttgttgccgttccggtgcagatttaccaaatgactgggtcctccggctatgtgggcttgaccgggctttttggccttattcctttggttatttttggcctttatggtggatccattgcggatgcttttgataaacgcatcgtgctgatctgcaccacgatcggcatgtgtgtcaccactgccggtttttgggtgctgaccattttaggcaatgagaatatttggctcctgttaataaacttttctttacagcaggcatttttcgcggtgaatcaacccacccgaacggcgatccttcgaagtattttgccgattgatcaattagcgtcggcaacatcactgaatatgctgctcatgcagaccggcgcaatcgttggcccgctgatcgcaggtgcgttgattccgctgatcggtttcgggtggctgtatttccttgatgttgtctccatcatccccacactgtgggctgtatggtcactgccttcgatcaagccatccggcaaggtgatgaaggctggtttcgccagtgtggtggatggcctgaagtatttggctggccaacccgtgttgttgatggtgatggtgctggatcttatcgccatgattttcggcatgccacgtgcgctttaccccgagatcgcagaagtgaacttcggtgggggtgacgccggtgcaacgatgctggcgttcatgtactcatccatggctgttggcgcagttcttggcggcgtgctgtctggttgggtggcccggattagccgccagggtgttgcagtttattggtgcatcatcgcctggggcgcagccgttgctttgggtggtgtggcaattgttgtcagccccggcgcggtgactgcgtgggcgtggatgttcatcatcatgatggtcattggtggcatggctgacatgttcagctcggcagttcgaaacgctattttgcagcagtctgctgcggaacatgtgcagggccgaatccaaggtgtgtggatcatcgtcgtggtgggtggacctcgtttagctgacgtccttcacggttgggccgctgagcccctcggcgcaggttggacggtattatggggcggagtagcggtggttgtactcactgcaatttgtatggtggcggtgcctaaattctggaaatacgagaaaccaaaaattaccggcatctaaatacttatccatgcccattt

SEQ ID NO: 168 - protein, 424 aa, Corynebacterium glutamicum
VSFRDIFADTRPLKEPAFKRLWLGNVATVIGAQLTVVAVPVQIYQMTGSSGYVGLTGLFGLIPLVIFGLYGGSIADAFDKRIVLICTTIGMCVTTAGFWVLTILGNENIWLLLINFSLQQAFFAVNQPTRTAILRSILPIDQLASATSLNMLLMQTGAIVGPLIAGALIPLIGFGWLYFLDVVSIIPTLWAVWSLPSIKPSGKVMKAGFASVVDGLKYLAGQPVLLMVMVLDLIAMIFGMPRALYPEIAEVNFGGGDAGATMLAFMYSSMAVGAVLGGVLSGWVARISRQGVAVYWCIIAWGAAVALGGVAIVVSPGAVTAWAWMFIIMMVIGGMADMFSSAVRNAILQQSAAEHVQGRIQGVWIIVVVGGPRLADVLHGWAAEPLGAGWTVLWGGVAVVVLTAICMVAVPKFWKYEKPKITGI

SEQ ID NO: 169 - DNA, 945 bp, Corynebacterium glutamicum
  CDS (101)..(922): FRXA01936
tttacagcaggcatttttcgcggtgaatcaacccacccgaacggcgatccttcgaagtattttgccgattgatcaataagcgtcggcaacatcactgaatatgctgctcatgcagaccggcgcaatcgttggcccgctgatcgcaggtgcgttgattccgctgatcggtttcgggtggctgtatttccttgatgttgtctccatcatccccacactgtgggctgtatggtcactgccttcgatcaagccatccggcaaggtgatgaaggctggtttcgccagtgtggtggatggcctgaagtatttggctggccaacccgtgttgttgatggtgatggtgctggatcttatcgccatgattttcggcatgccacgtgcgctttaccccgagatcgcagaagtgaacttcggtgggggtgacgccggtgcaacgatgctggcgttcatgtactcatccatggctgttggcgcagttcttggcggcgtgctgtctggttgggtggcccggattagccgccagggtgttgcagtttattggtgcatcatcgcctggggcgcagccgttgctttgggtggtgtggcaattgttgtcagccccggcgcggtgactgcgtgggcgtggatgttcatcatcatgatggtcattggtggcatggctgacatgttcagctcggcagttcgaaacgctattttgcagcagtctgctgcggaacatgtgcagggccgaatccaaggtgtgtggatcatcgtcgtggtgggtggacctcgtttagctgacgtccttcacggttgggccgctgagcccctcggcgcaggttggacggtattatggggcggagtagcggtggttgtactcactgcaatttgtatggtggcggtgcctaaattctggaaatacgagaaaccaaaaattaccggcatctaaatacttatccatgcccattt

SEQ ID NO: 170 - protein, 274 aa, Corynebacterium glutamicum
MLLMQTGAIVGPLIAGALIPLIGFGWLYFLDVVSIIPTLWAVWSLPSIKPSGKVMKAGFASVVDGLKYLAGQPVLLMVMVLDLIAMIFGMPRALYPEIAEVNFGGGDAGATMLAFMYSSMAVGAVLGGVLSGWVARISRQGVAVYWCIIAWGAAVALGGVAIVVSPGAVTAWAWMFIIMMVIGGMADMFSSAVRNAILQQSAAEHVQGRIQGVWIIVVVGGPRLADVLHGWAAEPLGAGWTVLWGGVAVVVLTAICMVAVPKFWKYEKPKITGI

SEQ ID NO: 171 - DNA, 549 bp, Corynebacterium glutamicum
  CDS (101)..(526): FRXA01937
gcgcggtgacaccacagccgttgtcagcggcgcttggtctgtggaggatcgccgaggttactaacaaataggcccaacaaagaggtctaagctctacctggtgagtttccgagatattttcgctgacaccagaccgctgaaagaaccggccttcaaacgcctctggcttggcaatgttgccaccgtcattggtgcccaattaactgttgttgccgttccggtgcagatttaccaaatgactgggtcctccggctatgtgggcttgaccgggctttttggccttattcctttggttatttttggcctttatggtggatccattgcggatgcttttgataaacgcatcgtgctgatctgcaccacgatcggcatgtgtgtcaccactgccggtttttgggtgctgaccattttaggcaatgagaatatttggctcctgttaataaacttttctttacagcaggcatttttcgcggtgaatcaacccacccgaacggcgatccttcgaagtattttgccgattgatcaataagcgtcggcaacatcactgaa

SEQ ID NO: 172 - protein, 142 aa, Corynebacterium glutamicum
VSFRDIFADTRPLKEPAFKRLWLGNVATVIGAQLTVVAVPVQIYQMTGSSGYVGLTGLFGLIPLVIFGLYGGSIADAFDKRIVLICTTIGMCVTTAGFWVLTILGNENIWLLLINFSLQQAFFAVNQPTRTAILRSILPIDQ

SEQ ID NO: 173 - DNA, 1242 bp, Corynebacterium glutamicum
  CDS (101)..(1219): RXN01010
gtgccaaagcgtttcctgtaaaacgcataaccccgaataccccctgtttccagatccaaaaaaagatctggcagggggtttaggcatagattaggaacttatgaagaaactgcaaatgccggccattttggtcggaggctttgtggggccgtttactggccaagctctatcagtggtcttgccggaatttgcagacacctttgatatcagtgtcagccaggcagcgctgaccatgaccgcatacttgttgccctttgccaccatgatgttgttttcggggcgcatcaccagaaagatccatccgcataaggtggtgcaggcggcttatattgtcacactgccacttgcgctgttgctcctagttacaccatcgtgggggctgtttatggctgcgtatgccacgattggtatcgctaatgcatttaccactccggtgctgcaaattatgttgcgtgagcttgttccgccgcgttctttgggtaaggcattgggcacctatgctgcgatgcaatcactcggcatgttgtcggcgccactgatcgcaggtgtgtcttcggtggtgtcgtggaggttgaccttcctggtcactgcagcagcgtcactgtttattttggtggcgcgactccccgttgttccaccaccatcagcatcgaagcaaaacgttagtggcaaggtgcagtggggaccgaccatcatccacatggtttccggctttgtggtgggcatcggcatcatcggcattggattcatgacatcgctgcacgttggcgagcaattcggacttgatgctgcagcgcgtggtttggtggtcatgtgtggtggcctggctgcgttctttgcctcccgcaagattggcgatttggcagacaaatttggtgtgcgcgcggtgctcattgtcagtgctgtcatcggtaccatcgcactcgcactgctgccgatcgcaccgtggatcattgtggtggccgtactgtgggccttcgcagtagcagcagcacaaggaatccaagcaaccgtcaacttggctgtcatcggaagccccggtggatcatcgctgctttctaccgtgcaggctttccgattcttcggatcagcggcagcaccagtgacattccttcctatctatatgggcatcggctcgggggcgttttgggtcagcgcggtagcgctgttcttcgttgccatcgcccagtggctcaacccgcagcgggtggagcggggctgagggagacgtcgagaagcgtc

SEQ ID NO: 174 - protein, 373 aa, Corynebacterium glutamicum
MKKLQMPAILVGGFVGPFTGQALSVVLPEFADTFDISVSQAALTMTAYLLPFATMMLFSGRITRKIHPHKVVQAAYIVTLPLALLLLVTPSWGLFMAAYATIGIANAFTTPVLQIMLRELVPPRSLGKALGTYAAMQSLGMLSAPLIAGVSSVVSWRLTFLVTAAASLFILVARLPVVPPPSASKQNVSGKVQWGPTIIHMVSGFVVGIGIIGIGFMTSLHVGEQFGLDAAARGLVVMCGGLAAFFASRKIGDLADKFGVRAVLIVSAVIGTIALALLPIAPWIIVVAVLWAFAVAAAQGIQATVNLAVIGSPGGSSLLSTVQAFRFFGSAAAPVTFLPIYMGIGSGAFWVSAVALFFVAIAQWLNPQRVERG

SEQ ID NO: 175 - DNA, 871 bp, Corynebacterium glutamicum
  CDS (101)..(871): FRXA01010
gtgccaaagcgtttcctgtaaaacgcataaccccgaataccccctgtttccagatccaaaaaaagatctggcagggggtttaggcatagattaggaacttatgaagaaactgcaaatgccggccattttggtcggaggctttgtggggccgtttactggccaagctctatcagtggtcttgccggaatttgcagacacctttgatatcagtgtcagccaggcagcgctgaccatgaccgcatacttgttgccctttgccaccatgatgttgttttcggggcgcatcaccagaaagatccatccgcataaggtggtgcaggcggcttatattgtcacactgccacttgcgctgttgctcctagttacaccatcgtgggggctgtttatggctgcgtatgccacgattggtatcgctaatgcatttaccactccggtgctgcaaattatgttgcgtgagcttgttccgccgcgttctttgggtaaggcattgggcacctatgctgcgatgcaatcactcggcatgttgtcggcgccactgatcgcaggtgtgtcttcggtggtgtcgtggaggttgaccttcctggtcactgcagcagcgtcactgtttattttggtggcgcgactccccgttgttccaccaccatcagcattgaagcaaaacgttagtggcaaggtgcagtggggaccgaccatcatccacatggtttccggctttgtggtgggcatcggcatcatcggcattggattcatgacatcgctgcacgttggcgagcaattcggacttaatactgcagcgcgtggtttggtggtcatgtgtggtggccgggctgcgttctttgcctcccgcaagataggcgatttggcagacaaa

SEQ ID NO: 176 - protein, 257 aa, Corynebacterium glutamicum
MKKLQMPAILVGGFVGPFTGQALSVVLPEFADTFDISVSQAALTMTAYLLPFATMMLFSGRITRKIHPHKVVQAAYIVTLPLALLLLVTPSWGLFMAAYATIGIANAFTTPVLQIMLRELVPPRSLGKALGTYAAMQSLGMLSAPLIAGVSSVVSWRLTFLVTAAASLFILVARLPVVPPPSALKQNVSGKVQWGPTIIHMVSGFVVGIGIIGIGFMTSLHVGEQFGLNTAARGLVVMCGGRAAFFASRKIGDLADK

SEQ ID NO: 177 - DNA, 1266 bp, Corynebacterium glutamicum
  CDS (101)..(1243): RXN03142
gcaatttggccaatcaacaacataggaggactgcgtggcggtcaccgcaagaacggacataaaaccacacccatcgcaaccaacggcactgttcactccagtgtttattttgggctggctcgtcaacttgacccagtacttgagcttctacttcctgatcacagtcatggcgctgtatgcgatggaaagcttcgccgtttcagaggccgctgtcggatttgcggccagctcctttgttatcggcgcaaccgtggctcgtgtgttcgcgggatggacgtccgaccgttttggtaaaaaacagatcctgctcatctttgtcggcttggaagcggtagcatcactattctatattccagctgcctcactaccagcgctggttgctgtgcgttttgttcacggtttttcttattctcttgcttccaccgctgtgatggcacttgtgcagtccgtgattcctgcaagccgtagggcagagggcaccggctacttcgcgctcggatccacactggctacagctttcggcccagcaattgcgctgtttgttatcgatgacttcaactacaacaccctgttctggattaccactgcgaccagtgttttcggcctgatcctcaccgttttgatccgcaagccggagttcattaagaatgcggaacacggcagagtaaagccagtctggtctatcaagactgttgtgcacccatcggtcatgctcattggattcttcatgctcgctgtcggactggcttacgcaggcgtgatcaccttcctcaacggcttcgcgcaagacactggcctcaccgccggagcgggtcttttctttatcgcttatgcggttgcgatgctggtcatgcgtttcttccttggacgcattcaggacaaacatggtgacaacccggttatttacttcggtttgatcagcttcgccctcgcgctggggcttatggctttggcgactgaagactggcacattgttctcgctggcgcactcaccggtttgggctatggcaccatcatgccggccgcacaagccattgctgtcgattcagttccaagcactcaggttggttccggtatttctacgcttttcctgttcaccgacatcggcattggcttaggcccaatcctgctgggtggattggttgcagcgaccggatacaacgtcatgtacgcagctttggccgcagtgattgttgtggcgggcgtgctctacctggttgctttgggtaggaaagctagccactaagttagagcattttattgagc

SEQ ID NO: 178 - protein, 381 aa, Corynebacterium glutamicum
VFILGWLVNLTQYLSFYFLITVMALYAMESFAVSEAAVGFAASSFVIGATVARVFAGWTSDRFGKKQILLIFVGLEAVASLFYIPAASLPALVAVRFVHGFSYSLASTAVMALVQSVIPASRRAEGTGYFALGSTLATAFGPAIALFVIDDFNYNTLFWITTATSVFGLILTVLIRKPEFIKNAEHGRVKPVWSIKTVVHPSVMLIGFFMLAVGLAYAGVITFLNGFAQDTGLTAGAGLFFIAYAVAMLVMRFFLGRIQDKHGDNPVIYFGLISFALALGLMALATEDWHIVLAGALTGLGYGTIMPAAQAIAVDSVPSTQVGSGISTLFLFTDIGIGLGPILLGGLVAATGYNVMYAALAAVIVVAGVLYLVALGRKASH

SEQ ID NO: 179 - DNA, 914 bp, Corynebacterium glutamicum
  CDS (1)..(891): FRXA01150
ccagctgcctcactaccagcgctggttgctgtgcgttttgttcacggtttttcttattctcttgcttccaccgctgtgatggcacttgtgcagtccgtgattcctgcaagccgtagggcagagggcaccggctacttcgcgctcggatccacactggctacagctttcggcccagcaattgcgctgtttgttatcgatgacttcaactacaacaccctgttctggattaccactgcgaccagtgttttcggcctgatcctcaccgttttgatccgcaagccggagttcattaagaatgcggaacacggcagagtaaagccagtctggtctatcaagactgttgtgcacccatcggtcatgctcattggattcttcatgctcgctgtcggactggcttacgcaggcgtgatcaccttcctcaacggcttcgcgcaagacactggcctcaccgccggagcgggtcttttctttatcgcttatgcggttgcgatgctggtcatgcgtttcttccttggacgcattcaggacaaacatggtgacaacccggttatttacttcggtttgatcagcttcgccctcgcgctggggcttatggctttggcgactgaagactggcacattgttctcgctggcgcactcaccggtttgggctatggcaccatcatgccggccgcacaagccattgctgtcgattcagttccaagcactcaggttggttccggtatttctacgcttttcctgttcaccgacatcggcattggcttaggcccaatcctgctgggtggattggttgcagcgaccggatacaacgtcatgtacgcagctttggccgcagtgattgttgtggcgggcgtgctctacctggttgctttgggtaggaaagctagccactaagttagagcattttattgagc

SEQ ID NO: 180 - protein, 297 aa, Corynebacterium glutamicum
PAASLPALVAVRFVHGFSYSLASTAVMALVQSVIPASRRAEGTGYFALGSTLATAFGPAIALFVIDDFNYNTLFWITTATSVFGLILTVLIRKPEFIKNAEHGRVKPVWSIKTVVHPSVMLIGFFMLAVGLAYAGVITFLNGFAQDTGLTAGAGLFFIAYAVAMLVMRFFLGRIQDKHGDNPVIYFGLISFALALGLMALATEDWHIVLAGALTGLGYGTIMPAAQAIAVDSVPSTQVGSGISTLFLFTDIGIGLGPILLGGLVAATGYNVMYAALAAVIVVAGVLYLVALGRKASH

SEQ ID NO: 181 - DNA, 1341 bp, Corynebacterium glutamicum
  CDS (101)..(1318): RXN02964
ttttatatcctagcaagggtgttgcatgatgcaataaacgtggtagtttgtgttcataacaaaattgcatgatgcaataatttcgatttaaaggagaacagtgtccgtagctgaagaagggaaactttttacaccaacgtttgtcatgggatggtttgccaaccttttccagttcctggtgttctacttcctcatcaccaccatggctttgtacgccatcaaggaatttcaagcctctgaagtagaagctggcttcgcatccagctcaattgttatcggcgcagtcttttccaggtttttctccggctatattattgaccgttttggtcgacgcaagattgtgctcatctcagtcctagtcactaccattgcgtgtgccttgtaccttcccatcgaatcattgccattgctatacgcaaacaggttcctccacggtgttggatacgcttttgctgccaccgcgatcatggcaatggtccaggagctcattccagcgtcacgacgttccgaaggtactggttacctggcattgggcactaccgtttctgcagcacttggaccagccctagcactttttgtcctaggaacatttgattacgacatgctgtttatcgtggtcttggcaacctcggtcatctctttgatcgccgtcgtgttcatgtactttaagaccagcgaccctgagccttctggggaaccagccaagttcagcttcaaatctattatgaacccaaagatcatccccatcggcatctttatcttgcttatttgctttgcttactctggcgtcattgcctacatcaacgcatttgctgaagaacgcgatctgattacgggtgctggattgttcttcattgcctacgcagtatcaatgtttgtgatgcgcagcttccttggcaaactgcaggaccgtcgcggagacaacgtcgttatttactttggattgttcttcttcgttatttccttgacgattttgtcctttgccacttccaactggcacgttgtgttgtccggagtcattgcaggtctgggatacggcactttgatgccagcagtgcagtccatcgctgttggtgtagtagacaaaaccgaattcggtacggccttctccactttgttcctgtttgtggacttaggttttggctttggacctattatcctgggagcagtttctgcggcaattggtttcggacctatgtatgcagcactggcaggtgtgggtgtgattgccggaatcttctacctgttcacacacgctcgcaccgatcgagctaagaatggctttgttaaacacccagagcctgtcgctttagttagctagttctttcagctttccctccc

SEQ ID NO: 182 - protein, 406 aa, Corynebacterium glutamicum
VSVAEEGKLFTPTFVMGWFANLFQFLVFYFLITTMALYAIKEFQASEVEAGFASSSIVIGAVFSRFFSGYIIDRFGRRKIVLISVLVTTIACALYLPIESLPLLYANRFLHGVGYAFAATAIMAMVQELIPASRRSEGTGYLALGTTVSAALGPALALFVLGTFDYDMLFIVVLATSVISLIAVVFMYFKTSDPEPSGEPAKFSFKSIMNPKIIPIGIFILLICFAYSGVIAYINAFAEERDLITGAGLFFIAYAVSMFVMRSFLGKLQDRRGDNVVIYFGLFFFVISLTILSFATSNWHVVLSGVIAGLGYGTLMPAVQSIAVGVVDKTEFGTAFSTLFLFVDLGFGFGPIILGAVSAAIGFGPMYAALAGVGVIAGIFYLFTHARTDRAKNGFVKHPEPVALVS

SEQ ID NO: 183 - DNA, 1006 bp, Corynebacterium glutamicum
  CDS (101)..(1006): FRXA02116
ttttatatcctagcaagggtgttgcatgatgcaataaacgtggtagtttgtgttcataacaaaattgcatgatgcaataatttcgatttaaaggagaacagtgtccgtagctgaagaagggaaactttttacaccaacgtttgtcatgggatggtttgccaaccttttccagttcctggtgttctacttcctcatcaccaccatggctttgtacgccatcaaggaatttcaagcctctgaagtagaagctggcttcgcatccagctcaattgttatcggcgcagtcttttccaggtttttctccggctatattattgaccgttttggtcgacgcaagattgtgctcatctcagtcctagtcactaccattgcgtgtgccttgtaccttcccatcgaatcattgccattgctatacgcaaacaggttcctccacggtgttggatacgcttttgctgccaccgcgatcatggcaatggtccaggagctcattccagcgtcacgacgttccgaaggtactggttacctggcattgggcactaccgtttctgcagcacttggaccagccctagcactttttgtcctaggaacatttgattacgacatgctgtttatcgtggtcttggcaacctcggtcatctctttgatcgccgtcgtgttcatgtactttaagaccagcgaccctgagccttctggggaaccagccaagttcagcttcaaatctattatgaacccaaagatcatccccatcggcatctttatcttgcttatttgctttgcttactctggcgtcattgcctacatcaacgcatttgctgaagaacgcgatctgattacgggtgctggattgttcttcattgcctacgcagtatcaatgtttgtgatgcgcagcttccttggcaaactgcaggaccgtcgcggagacaacgtcgttatttactttggattgttcttcttcgttatttccttgacgattttgtcctttgccacttccaactggcacgttgtg

SEQ ID NO: 184 - protein, 302 aa, Corynebacterium glutamicum
VSVAEEGKLFTPTFVMGWFANLFQFLVFYFLITTMALYAIKEFQASEVEAGFASSSIVIGAVFSRFFSGYIIDRFGRRKIVLISVLVTTIACALYLPIESLPLLYANRFLHGVGYAFAATAIMAMVQELIPASRRSEGTGYLALGTTVSAALGPALALFVLGTFDYDMLFIVVLATSVISLIAVVFMYFKTSDPEPSGEPAKFSFKSIMNPKIIPIGIFILLICFAYSGVIAYINAFAEERDLITGAGLFFIAYAVSMFVMRSFLGKLQDRRGDNVVIYFGLFFFVISLTILSFATSNWHVV

SEQ ID NO: 185 - DNA, 568 bp, Corynebacterium glutamicum
  CDS (101)..(568): RXA00858
ttttgtttttcagatgcatgttagatgcgttgagggacaagggtgggggagacctccggttcttaaattgtctaaccaagaaccggaggttctttttgtcatggaagtaaacttagccacatggctaatcactatcgcagtgattgctggcttcttcattttcgatttctattcccacgtccgcaccccacacgagcccactatcaaagaatccgcatggtggagcctcttctacgtagccctcgcctgtgttttcggcgtgttcctctggtttgcttggggcgagccaggtaacccacaccagcacggcattgagttcttcaccggttacgtgacagagaaggcgttgagtgttgataacctcttcatcttcgcgctgatcatgggttctttcaagattcctcgcaagtaccagcagaaggttctgctcatcggtatcgcgctggcactggtcttccgcctggcattcatcctcgcaggtgctgcagttatcgaagcctggtccgatgtcttctacatcttctccatctggctgatctacaccgctgtgaaggctcctgtgcacgag

SEQ ID NO: 186 - protein, 156 aa, Corynebacterium glutamicum
MEVNLATWLITIAVIAGFFIFDFYSHVRTPHEPTIKESAWWSLFYVALACVFGVFLWFAWGEPGNPHQHGIEFFTGYVTEKALSVDNLFIFALIMGSFKIPRKYQQKVLLIGIALALVFRLAFILAGAAVIEAWSDVFYIFSIWLIYTAVKAPVHE

SEQ ID NO: 187 - DNA, 975 bp, Corynebacterium glutamicum
  CDS (101)..(952): RXA02305
tatgcgcgcaggtgtctactggtgacgcagccgacgacgattattttgacgaagccaccgcaaacgatgacttcgatcccgaaaagtggaggaacatgtaatgccagcctttgaggcaatgccaggaatgccgtattggatcgacctgtccacctcggacattgcaaaatctgcacacttctacgaaaacgttctcggctgggaaattgaagaagtcaacgatggctaccgcatggctcgtctgcagggactacccgtggcagggctgatcgatcagcgcggtgaatcaagcatcccggatacctggattacctacttcctctcctacgatctggatgccactgcaaagaagatcgcagaactgggtggacgaattctggccgagccaactgacgtgcacttgggacgcatgatcctagctgttgatactgccggcgcactgttcggcgttattgagccaggcagcgaggaatcattcgtcgctgctggtgaaccaggcacatccgtgtggcatgaactcaccactgtctccaaatattccgaagctatcgatttctacggtgagctgttcacttggacaacctctgaaatggctagtgctgaagacgatagtttccgctacaccaccgcattggctgacggttccgcctttgctggaatttttgatgccaaaggccacttcccacctcaggttccaagcttctggcagtcctaccttggcgtgctcaacgccgatgatgctgcagcgaaggccaaggaatttggtggcgatgttattcgtaagccatgggactcagaatttggccgcatggttctcatctctgattccactggtgccacaattaccttgtgtgaagtagaggaatacgtcgaggaagcagcagaaggcgatgatctcttcgacatcgatctcagtgctttcgaagagcagttccgcaagcaagaaggacagtaatcctacagcgccatggagga

SEQ ID NO: 188 - protein, 284 aa, Corynebacterium glutamicum
MPAFEAMPGMPYWIDLSTSDIAKSAHFYENVLGWEIEEVNDGYRMARLQGLPVAGLIDQRGESSIPDTWITYFLSYDLDATAKKIAELGGRILAEPTDVHLGRMILAVDTAGALFGVIEPGSEESFVAAGEPGTSVWHELTTVSKYSEAIDFYGELFTWTTSEMASAEDDSFRYTTALADGSAFAGIFDAKGHFPPQVPSFWQSYLGVLNADDAAAKAKEFGGDVIRKPWDSEFGRMVLISDSTGATITLCEVEEYVEEAAEGDDLFDIDLSAFEEQFRKQEGQ

SEQ ID NO: 189 - DNA, 948 bp, Corynebacterium glutamicum
  CDS (101)..(925): RXA00084
tcacccttgtcgataccagctactgggtatctggcgtcggtccacttggcggcagcaaagtcttggaagacatcgatgccttcctcgacgcacagcaataatgtccacagctctccccgatcagctcaagtgggaatacagtgccttccccgtgcagatctcgcagaagcaacggcttagtcccggcttcatgcggatcaccgtcactggtgacaagctccgattctttggccagtggggtttggaccaacgcatcaaactgatcattccaagcccggctgggaacatcccagatttcggaattctcgacgaacccactcccccaccgacaacgtggcttcctcgtgctaagtcttttccagcggaccaacgaccgatcttgcgcacctacaccccatctgcggtccgacccgaactatgcgaagtagacattgatatctatcttcacaacccttcgggaccagtatccagatgggcaaagaactgcagtgttgacgatgaactaatcatcaccggccctgacgtacgcgcaggagaaaccggctacggaatcacctatcatccgacttctgcgatcgatcgcctctgtctcatcggcgattgtgcatcagctcccgcgatcgcaaatatcgtcaatcaatcaaaagtacctactacggttttcctccacgtagacagcctagaagatgatgtattgatcgccgatagctccaccaagctcactttcgaagacatcgacgcttacaaagcaaaggtcttccaatgggcttcagccaatgcagcagatccttcagtacacttctggatcgccggtgaaactagcatggtgcgcttcattcgcaaagaactaatcaacagctaccgagttgattcctcacgaatcactttcctcggctactggaaatacggccgacgaaccgtagactagctttcagattcagaccccag

SEQ ID NO: 190 - protein, 275 aa, Corynebacterium glutamicum
MSTALPDQLKWEYSAFPVQISQKQRLSPGFMRITVTGDKLRFFGQWGLDQRIKLIIPSPAGNIPDFGILDEPTPPPTTWLPRAKSFPADQRPILRTYTPSAVRPELCEVDIDIYLHNPSGPVSRWAKNCSVDDELIITGPDVRAGETGYGITYHPTSAIDRLCLIGDCASAPAIANIVNQSKVPTTVFLHVDSLEDDVLIADSSTKLTFEDIDAYKAKVFQWASANAADPSVHFWIAGETSMVRFIRKELINSYRVDSSRITFLGYWKYGRRTVD

SEQ ID NO: 191 - DNA, 468 bp, Corynebacterium glutamicum
  CDS (101)..(445): RXA00843
gccctgatgcgaaaccggcgccaacaatgatgccgacgaaggcaaatgccactcttaggatttgaataatcatggaacaaaccttagtaggctcaacgttatgaaagtcacgattttccataatccgcgttgttccacatccagaaataccctcgcttacctccgcgacaaggacattgagcctgaaattgttcagtatctcaaagacacgcccaccgcttccgagctcaaagaactattcaatacgctgggaattccagtccacgacggcatcagaacccgcgaagctgagtacacagaactgggcctgtcaccagaaacacctgaaactgagcttatcgacgccatcgttgcccatcccaggctccttcagcgtccgatcgtggtgacggccaaaggcgcgcgcattgcgcgccccaaaatcgacgtcattgacagcatcttgtgacaacattttgtagagcaacc

SEQ ID NO: 192 - protein, 115 aa, Corynebacterium glutamicum
MKVTIFHNPRCSTSRNTLAYLRDKDIEPEIVQYLKDTPTASELKELFNTLGIPVHDGIRTREAEYTELGLSPETPETELIDAIVAHPRLLQRPIVVTAKGARIARPKIDVIDSIL

SEQ ID NO: 193 - DNA, 432 bp, Corynebacterium glutamicum
  CDS (101)..(409): RXA01052
tatggccaaccctagggggatggcctgtgtgttcactgttaggtttcctcaaaatctttaacgaacaacgaagagcttgcccgagagtatcttgggtcgcatggacacaaaattaggcgctgaattgggtactgaatttgatctcattgttgttggtttcggcaaagcaggcaagactatcgcgatgaaacgctcggcagcgggggataaggtcgcactgatcgagcagagtccacagatgtatggcggtacctgcatcaatgtaggttgcatccccacgaagaagttgttgtttgagactgcaacgggcaaggatttcccggatgcggttgtggcgcgtgatcagttgattggcaagctgaatgccaagaatcttgcgatggccacagacaagggtgtcacccgtcattgatggaaaagctacgtttacag

SEQ ID NO: 194 - protein, 103 aa, Corynebacterium glutamicum
MDTKLGAELGTEFDLIVVGFGKAGKTIAMKRSAAGDKVALIEQSPQMYGGTCINVGCIPTKKLLFETATGKDFPDAVVARDQLIGKLNAKNLAMATDKGVTRH

SEQ ID NO: 195 - DNA, 543 bp, Corynebacterium glutamicum
  CDS (101)..(520): RXA01053
ttgcgatggccacagacaagggtgtcacccgtcattgatggaaaagctacgtttacagctagccacgaaatcacaagtaacttcaggtagtgacactcttgtgctgtatgcgccaacgattgtgatcaacacgggctccacgccggtcatccccaatgtcccaggcaccgacaatccgcatgtttttgattccactggcattcagcacatttcgcccctgccgaagcacctcgcgatcatcggcggtggccccatcggtttggaatttgccacgcttttcagtggacaaggctccaaagtcaccatcatcgaccgtggtgaattgccgctgaaaaatttcgacagggaagtagcggagctggccaaaaccgacctggaggcccgcggaatcaccttcctcaacaacgctgaactcaccggattcagcggtgacctcaccatcgcgctcaaagaccacgacctcctcgccgacgccgcactttttgcatcggccgacgcccggcaccgacgggctcggccttgaacaggcgggcatcaaaacag

SEQ ID NO: 196 - protein, 140 aa, Corynebacterium glutamicum
VLYAPTIVINTGSTPVIPNVPGTDNPHVFDSTGIQHISPLPKHLAIIGGGPIGLEFATLFSGQGSKVTIIDRGELPLKNFDREVAELAKTDLEARGITFLNNAELTGFSGDLTIALKDHDLLADAALFASADARHRRARP

SEQ ID NO: 197 - DNA, 612 bp, Corynebacterium glutamicum
  CDS (101)..(589): RXA01054
gacctcctcgccgacgccgcactttttgcatcggccgacgcccggcaccgacgggctcggccttgaacaggcgggcatcaaaacaggcacgcgtggggaggtgcttgtcgacgcccacctccggaccaacatcgacggcatcttcgctgtaggtgatgtcaatggcggcccgcagtttacctacgtgtcctacgatgaccaccgcattgtgctggatcaactagccggaacaggtaagaaatccattgcacaccgactgatccccaccaccacgttcatcgaaccgccgttatccaccatcggtgacaacactgaaggggaaaatgtggtggtgaaaaaggccttgattgcagatatgccgatcgttccccgaccagagattattaaccaacctcacggtatggtgaagtttttcgtcgacaagcaatctgatgcgctgctcggcgcgaccttgtactgcgccgactcccaggagctcatcaacaccgtggcgcttgccatgcggcatggcgtcaccgcctccgagcttggcgacggcatctacacccaccccgccacctcggagatcttcaaccaattattgggcagttaacgcagcggatcgaacggctt

SEQ ID NO: 198 - protein, 163 aa, Corynebacterium glutamicum
VLVDAHLRTNIDGIFAVGDVNGGPQFTYVSYDDHRIVLDQLAGTGKKSIAHRLIPTTTFIEPPLSTIGDNTEGENVVVKKALIADMPIVPRPEIINQPHGMVKFFVDKQSDALLGATLYCADSQELINTVALAMRHGVTASELGDGIYTHPATSEIFNQLLGS

SEQ ID NO: 199 - DNA, 561 bp, Corynebacterium glutamicum
  CDS (101)..(538): RXN03123
agctctaccaacgcgcctacaccttgaccaacgtggatgccgatgccggtacctttgacctggcttttgtgctgcacgagccgctggggcccgcctcggcgtgggcgacgcgctgcgaggccggggaaagcctgaagtcatgcgctacccaggaattccgttcgccatcccagatccagcgccgcgtggcttccttttcttaggcgatctcacctcttacccagcgatctgctcgattctggagaccttggacggtgaaatccctgcgaccgcgtatcttatcgcccacgatccacttgattacaccttcgattttccccagggcgagcacatcaccgcgcagtggatttccaacgaacaatccttcattgatcacatcgctgacacggattacaccgatttttatacctggatcggcgcggaatcctccgaaacccgtgcggccaagaagcatctgcagacccacgccggcatgcccaagacgcacatgaacgcgcaaggttattggaacaagggcagagccatgggtaaaagcaattaaaagatttttgcttatcgacg

SEQ ID NO: 200 - protein, 146 aa, Corynebacterium glutamicum
VGDALRGRGKPEVMRYPGIPFAIPDPAPRGFLFLGDLTSYPAICSILETLDGEIPATAYLIAHDPLDYTFDFPQGEHITAQWISNEQSFIDHIADTDYTDFYTWIGAESSETRAAKKHLQTHAGMPKTHMNAQGYWNKGRAMGKSN

SEQ ID NO: 201 - DNA, 736 bp, Corynebacterium glutamicum
  CDS (101)..(736): FRXA00993
gctgagctagtgcttttgcgacacacctcttgcgaatgttgattaggttaggcaagccatatttacagggtgttgtgaaagcataagggagcaaggaaacatgggcaagggatttaccggcgctattttgaccgtcatgggcgtgaaatcgcatatcgccaccaccacgggaaaaaccgtgatcaatgaccgcatggtgaccattcattttcattccgagacgctgctcaacacggaaggtgaagtccccggcgattggctgcgtctgtggttcccgcacgagagccgacctggaaagctctaccaacgcgcctacaccttgaccaacgtggatgccgatgccggtacctttgacctggcttttgtgctgcacgagccgctggggcccgcctcggcgtgggcgacgcgctgcgaggccggggaaagcctggaagtcatgcgctacccaggaattccgttcgccatcccagatccagcgccgcgtggcttccttttcctaggcgatctcacctcttacccagcgatctgctcgattctggagaccttggacggtgaaatccctgcgaccgcgtatcttatcgcccacgatccacttgattacaccttcgattttccccagggcgagcacatcaccgcgcagtggatttccaacgaacaatccttcattgatcacatcgctgacacggattacaccgatttttatacctggatcggcgcggaatcctccgaaacccgt

SEQ ID NO: 202 - protein, 212 aa, Corynebacterium glutamicum
MGKGFTGAILTVMGVKSHIATTTGKTVINDRMVTIHFHSETLLNTEGEVPGDWLRLWFPHESRPGKLYQRAYTLTNVDADAGTFDLAFVLHEPLGPASAWATRCEAGESLEVMRYPGIPFAIPDPAPRGFLFLGDLTSYPAICSILETLDGEIPATAYLIAHDPLDYTFDFPQGEHITAQWISNEQSFIDHIADTDYTDFYTWIGAESSETR

SEQ ID NO: 203 - DNA, 732 bp, Corynebacterium glutamicum
  CDS (101)..(709): RXA01051
tgcgacccaagatactctcgggcaagctcttcgttgttcgttaaagattttgaggaaacctaacagtgaacacacaggccatccccctagggttggccatatgtcaaccattcacgcctccggaatccaggctccacaagtgccacacggttcccaccatgccccgccacaaaaggacgaatcagtgaagaagagcttcaatgcctcttctttactgttcgcgttttccttcggcgtgtacctggtgctgcttgtgatgatgacacttcttaaaagtcgcctttctttaggcggactgtggaacacagaagcacaccaatacagatccatcgacttagagcttttcaacggctttgctgatccaccaatttggtgggggccttggaccaacacttttggcaacatcgcactgttcatgccatttgggtttttcctgtacaaaatgctccgtagattcaaccatcgattccccttcgtagaaaccatcctgtttgccagcgtcaccagcctcagtatcgaagttctgcaatgggtgtttgctattggatattcagatgtcgatgacctgttgtttaatacgatcggcggactcattggagcatccgtagcagcgcttgtctcgcttaaatcctccaaggtagtcagcggaatcatcatgggcggttcactatctgtgatggcgatgatgatgtattcaagttttatcgcctagaaggtttcagcagttccgct

SEQ ID NO: 204 - protein, 203 aa, Corynebacterium glutamicum
MSTIHASGIQAPQVPHGSHHAPPQKDESVKKSFNASSLLFAFSFGVYLVLLVMMTLLKSRLSLGGLWNTEAHQYRSIDLELFNGFADPPIWWGPWTNTFGNIALFMPFGFFLYKMLRRFNHRFPFVETILFASVTSLSIEVLQWVFAIGYSDVDDLLFNTIGGLIGASVAALVSLKSSKVVSGIIMGGSLSVMAMMMYSSFIA

SEQ ID NO: 205 - DNA, 1359 bp, Corynebacterium glutamicum
  CDS (101)..(1336): RXN01873
ccgtcgttgcccatggtcacagcctacatgcacaaagtgaatcaaaaacagctatttctaacattttactaatatttgctgttggcgcatgatgaactccatgagccaagcaatagatagcaaggtcgaggcacacgaaggccacgaaggccacgaaggcatcgagcgaggaacacgcaattacaagcgcgctgtgtttgcgatgctggccgccggtcttgctgctttcaatggtctttattgcacgcaggcattgcttcccaccatgacggaagagttgggaattacgcccactgagtccgcgctgacggtgtcggctacgactggaatgttggcgctgtgtattgttccggcgtcgatactttcggagaaatttggtcgcggtcgggtgctgacaatttcactcacgttggccatcatcgtgggattaattttgccgcttgtccccaatattactgctctcatcctgctcagaggtctccaaggtgcgctgcttgctggcactccagcggtggcgatgacctggttgtctgaggaaattcaccccaaggatattgggcatgcgatgggaatttacatcgcgggaaatactgtcggcgggctcactggacgtatgattccggcgggactacttgaagtaactcattggcaaaacgcactgctgggaagttctatcgctgcgctgatcttcggcgtaatcatggtggtgttgcttcccaagcagcggaaattccagccgaagaatatcaatctgcgccatgagatttcggcgatggctgctcattggcggaatcctcgtttggcgttgctttttggtactgcgtttttgggcatgggtacttttgtgtcgctgtacaactatttgggtttccgcatgattgatcagtttgggctgagtgaagtgctggttggtgcggtgttcatcatgtatctggccgggacctggagttccacccaggcgggtgcgttgagggagaagatcggcaatgggtcaacggttattttcttgagtctgacgatgatcgcgtcgatggcactgatggggattaataatttgtgggtcacgttggttgccctgtttgtgtttaccgcggcatttttcgcactgcattccagtgcttcgggatggatcggaatcatcgcaacgaaggatcgcgcggaagcctccagcatgtatttgttctgttattacgtgggatcctcggtgattggttgggtttctggattcgcgtttacgcatttgccgtggttggcgttcattggctggttgattctgcttctttgcggagtgctggcgatttgtgtgacgctggcaaggcttgcccgcaacgccaattaatacgagtttgtccgtgttta

SEQ ID NO: 206 - protein, 412 aa, Corynebacterium glutamicum
MSQAIDSKVEAHEGHEGHEGIERGTRNYKRAVFAMLAAGLAAFNGLYCTQALLPTMTEELGITPTESALTVSATTGMLALCIVPASILSEKFGRGRVLTISLTLAIIVGLILPLVPNITALILLRGLQGALLAGTPAVAMTWLSEEIHPKDIGHAMGIYIAGNTVGGLTGRMIPAGLLEVTHWQNALLGSSIAALIFGVIMVVLLPKQRKFQPKNINLRHEISAMAAHWRNPRLALLFGTAFLGMGTFVSLYNYLGFRMIDQFGLSEVLVGAVFIMYLAGTWSSTQAGALREKIGNGSTVIFLSLTMIASMALMGINNLWVTLVALFVFTAAFFALHSSASGWIGIIATKDRAEASSMYLFCYYVGSSVIGWVSGFAFTHLPWLAFIGWLILLLCGVLAICVTLARLARNAN

SEQ ID NO: 207 - DNA, 1215 bp, Corynebacterium glutamicum
  CDS (101)..(1192): FRXA01873
ccgtcgttgcccatggtcacagcctacatgcacaaagtgaatcaaaaacagctatttctaacattttactaatatttgctgttggcgcatgatgaactccatgagccaagcaatagatagcaaggtcgaggcacacgaaggccacgaaggccacgaaggcatcgagcgaggaacacgcaattacaagcgcgctgtgtttgcgatgctggccgccggtcttgctgctttcaatggtctttattgcacgcaggcattgcttcccaccatgacggaagagttgggaattacgcccactgagtccgcgctgacggtgtcggctacgactggaatgttggcgctgtgtattgttccggcgtcgatactttcggagaaatttggtcgcggtcgggtgctgacaatttcactcacgttggccatcatcgtgggattaattttgccgcttgtccccaatattactgctctcatcctgctcagaggtctccaaggtgcgctgcttgctggcactccagcggtggcgatgacctggttgtctgaggaaattcaccccaaggatattgggcatgcgatgggaatttacatcgcgggaaatactgtcggcgggctcactggacgtatgattccggcgggactacttgaagtaactcattggcaaaacgcactgctgggaagttctatcgctgcgctgatcttcggcgtaatcatggtggtgttgcttcccaagcagcggaaattccagccgaagaatatcaatctgcgccatgagatttcggcgatggctgctcattggcggaatcctcgtttggcgttgctttttggtactgcgtttttgggcatgggtacttttgtgtcgctgtacaactatttgggtttccgcatgattgatcagtttgggctgagtgaagtgctggttggtgcggtgttcatcatgtatctggccgggacctggagttccacccaggcgggtgcgttgagggagaagatcggcaatgggtcaacggttattttcttgagtctgacgatgatcgcgtcgatggcactgatggggattaataatttgtgggtcacgttggttgccctgtttgtgtttaccgcggcatttttcgcactgcattccagtgcttcgggatggatcggaatcatcgcaacgaaggatcgcgcggaagcctccagcatgtatttgttctgtgaatactaggatcctcggtgattggttgg

SEQ ID NO: 208 - protein, 364 aa, Corynebacterium glutamicum
MSQAIDSKVEAHEGHEGHEGIERGTRNYKRAVFAMLAAGLAAFNGLYCTQALLPTMTEELGITPTESALTVSATTGMLALCIVPASILSEKFGRGRVLTISLTLAIIVGLILPLVPNITALILLRGLQGALLAGTPAVAMTWLSEEIHPKDIGHAMGIYIAGNTVGGLTGRMIPAGLLEVTHWQNALLGSSIAALIFGVIMVVLLPKQRKFQPKNINLRHEISAMAAHWRNPRLALLFGTAFLGMGTFVSLYNYLGFRMIDQFGLSEVLVGAVFIMYLAGTWSSTQAGALREKIGNGSTVIFLSLTMIASMALMGINNLWVTLVALFVFTAAFFALHSSASGWIGIIATKDRAEASSMYLFCEY

SEQ ID NO: 209 - DNA, 1572 bp, Corynebacterium glutamicum
  CDS (101)..(1549): RXN00034
taaattttgtggcactccccacatttctatcaatctatagaaagtatgacttaaagtcgattttgcaagtttctatagattgatagaaaagggagtttagatgtcttacacatcttttaaaggcgatgataaagccctcatcggcatagttttatcagttctcacattttggctttttgctcagtcaaccctaaatatcggcccagatatggcaactgatttagggatgagcgatggcaccatgaacatagctgtcgtggccgccgcgttattctgtggaacatttatcgtcgcagccggcggcatcgcagatgtctttggccgagtacgaatcatgatgattggcaacatccttaacatcctgggatctctcctcatcgccacggcaacgacttctttagccacccaaatggtgatcaccggccgagttctccaaggactggcagcagcggccatcatgtctgcatccctagcattagttaagacatattggttaggtactgaccgccaacgagcagtctccatttggtccattggttcatggggtggcaccggattctgcgcgcttttcgcgggtcttgttgtagcaagcccctttggttggagaggaatcttcgccctctgcgcgatcgtctccatcgttgctattgcccttacccgccacatcccggaatcccgtccggctcaatccattggcatgcatttggattggagtggcatcatcgttcttgccctcagtgttctatctcttgaattgtttattacccaaggtgaatcacttggctggacgcactggatgacctggactctccttgccgtttctttgacatttcttgcagttttcgtcttcattgaacgcatcgccagctggccagttctcgacttcaaccttttcaaagaccacgccttcagcggtgcgaccatcaccaacttcattatgagcgctactggcggagtagttgccgttgtcatgtgggttcagcaaatgggatggggtgtctccccaacaatctcgggactcaccagcatcggcttcgcagcctttgtcatccttttcattcgagttggagaaaaggccatgcagaaagttggcgcccgagcagtgatcatcaccgctggcatcttggtagcgaccgcgaccgccctcctaatgatcaccgcggtcagcgagtcaacgtacatcgtcatctccctcgccggcttctccctttatggccttggcctcggactcttcgccaccccagtcaccgatactgcgcttggaacacttcccaaagaccgtaccggcgctggtgcaggtgtattcaagatgtcctcttccctcggcgcagcactcggcatcgcaatctccacttcagtgttcctcgcacttcgcgacggcacctccatcaactccgacgtcgcactcgccggaacagtttcacttggcatcaacgttgtattcgcagcaacagccaccatcaccgcagcagtccttattccaaaagccgctggcaaagtctcacaaaccagcatcacccttcctgagccagctatcgctgtaaaaatctaaaacttcaccaggacagataa

SEQ ID NO: 210 - protein, 483 aa, Corynebacterium glutamicum
MSYTSFKGDDKALIGIVLSVLTFWLFAQSTLNIGPDMATDLGMSDGTMNIAVVAAALFCGTFIVAAGGIADVFGRVRIMMIGNILNILGSLLIATATTSLATQMVITGRVLQGLAAAAIMSASLALVKTYWLGTDRQRAVSIWSIGSWGGTGFCALFAGLVVASPFGWRGIFALCAIVSIVAIALTRHIPESRPAQSIGMHLDWSGIIVLALSVLSLELFITQGESLGWTHWMTWTLLAVSLTFLAVFVFIERIASWPVLDFNLFKDHAFSGATITNFIMSATGGVVAVVMWVQQMGWGVSPTISGLTSIGFAAFVILFIRVGEKAMQKVGARAVIITAGILVATATALLMITAVSESTYIVISLAGFSLYGLGLGLFATPVTDTALGTLPKDRTGAGAGVFKMSSSLGAALGIAISTSVFLALRDGTSINSDVALAGTVSLGINVVFAATATITAAVLIPKAAGKVSQTSITLPEPAIAVKI

SEQ ID NO: 211 - DNA, 1045 bp, Corynebacterium glutamicum
  CDS (101)..(1045): FRXA02273
taaattttgtggcactccccacatttctatcaatctatagaaagtatgacttaaagtcgattttgcaagtttctatagattgatagaaaagggagtttagatgtcttacacatcttttaaaggcgatgataaagccctcatcggcatagttttatcagttctcacattttggctttttgctcagtcaaccctaaatatcggcccagatatggcaactgatttagggatgagcgatggcaccatgaacatagctgtcgtggccgccgcgttattctgtggaacatttatcgtcgcagccggcggcatcgcagatgtctttggccgagtacgaatcatgatgattggcaacatccttaacatcctgggatctctcctcatcgccacggcaacgacttctttagccacccaaatggtgatcaccggccgagttctccaaggactggcagcagcggccatcatgtctgcatccctagcattagttaagacatattggttaggtactgaccgccaacgagcagtctccatttggtccattggttcatggggtggcaccggattctgcgcgcttttcgcgggtcttgttgtagcaagcccctttggttggagaggaatcttcgccctctgcgcgatcgtctccatcgttgctattgcccttacccgccacatcccggaatcccgtccggctcaatccattggcatgcatttggattggagtggcatcatcgttcttgccctcagtgttctatctcttgaattgtttattacccaaggtgaatcacttggctggacgcactggatgacctggactctccttgccgtttctttgacatttcttgcagttttcgtcttcattgaacgcatcgccagctggccagttctcgacttcaaccttttcaaagaccacgccttcagcggtgcgaccatcaccaacttcattatgagcgctactggcggagtagttgccgttgtcatgtgggttcagcaaatgggatggggtgtctccccaacaatctcgggactcaccagcatcggcttcgcagccttt

SEQ ID NO: 212 - protein, 315 aa, Corynebacterium glutamicum
MSYTSFKGDDKALIGIVLSVLTFWLFAQSTLNIGPDMATDLGMSDGTMNIAVVAAALFCGTFIVAAGGIADVFGRVRIMMIGNILNILGSLLIATATTSLATQMVITGRVLQGLAAAAIMSASLALVKTYWLGTDRQRAVSIWSIGSWGGTGFCALFAGLVVASPFGWRGIFALCAIVSIVAIALTRHIPESRPAQSIGMHLDWSGIIVLALSVLSLELFITQGESLGWTHWMTWTLLAVSLTFLAVFVFIERIASWPVLDFNLFKDHAFSGATITNFIMSATGGVVAVVMWVQQMGWGVSPTISGLTSIGFAAF

SEQ ID NO: 213 - DNA, 826 bp, Corynebacterium glutamicum
  CDS (101)..(826): RXN03075
tgtgcaaaattgcattcaggctgaaaaattcctaaagggactccgtccgaataattggaaagcccagaagaacagtcaactcctagattaaaggataatcgtggcgaaattcctgtataagttaggctccacggcctatcaaaagaaatggccgtttcttgcggtctggctcgtgattctcataggtatcacgacgctggcggggctgtatgccaagccaacgtcgagtagcttctctatccctggtcttgattctgtcacgaccatggagaagatgcaggagcgtttccctggttcggatgatgcaacatcggctcccactggttctgtcgtcattcaggcaccggaaggcaagaccctcactgatcctgaggttggggctgaagtaaaccagatgcttgatgaggttcgggcgactggtgtgctgaaggatgctgattccgttgtggatcctgtgttggctgcgcagggtgtggctgctcagatgaccccagccctggaggctcagggtgtacctgcggagaagatcgccgcagatattgagtcgattagtccactgagtgcagatgagactaccggcatcatctcgatgacttttgatgcagattctgccatggatatatccgcagaggatcgtgagaaggtcaccaatattcttgatgaatacgatgacggcgatctgactgttgtctacaacggcaacgtgtttggcgcagctgcaaccagcttggacatgacctctgagctcatcggcctgctggtggctgcggtcgttcttatcgtgaccttcggttcgttcatcgctgccggtatgccgctgatctct

SEQ ID NO: 214 - protein, 242 aa, Corynebacterium glutamicum
VAKFLYKLGSTAYQKKWPFLAVWLVILIGITTLAGLYAKPTSSSFSIPGLDSVTTMEKMQERFPGSDDATSAPTGSVVIQAPEGKTLTDPEVGAEVNQMLDEVRATGVLKDADSVVDPVLAAQGVAAQMTPALEAQGVPAEKIAADIESISPLSADETTGIISMTFDADSAMDISAEDREKVTNILDEYDDGDLTVVYNGNVFGAAATSLDMTSELIGLLVAAVVLIVTFGSFIAAGMPLIS

SEQ ID NO: 215 - DNA, 826 bp, Corynebacterium glutamicum; identical to SEQ ID NO: 213
  CDS (101)..(826): FRXA02907

SEQ ID NO: 216 - protein, 242 aa, Corynebacterium glutamicum; identical to SEQ ID NO: 214

SEQ ID NO: 217 - DNA, 2313 bp, Corynebacterium glutamicum
  CDS (101)..(2290): RXA00479
tagatcccaaggctcaaaatttattacttaaacaagttgagcaactagccagccgcaaatcttagaactaacctttacgcctttaacggaagtgaatttgatgtctactagcatcacaacagagaacaagaagaaatctggtcctcctcgcttgatgagaatctttctgcccgccttgctaattttagtttggcttgtaggagctggagtcggcggtccttattttggcaaggttagtgaggtctcctccaacagccagaccacatatctgccagaatctgccgatgccactcaagtacaggaacagttgggagattttactgattctgaatccatcccagccattgtcgtaatggtcagcgatgaacccttaacacagcaagacatcacacaactcaatgaagttgttgctgggctttcagaattagacatagtttccgatgaagtctcccctgctattccatccgaggacggcagagctgtccaagtgtttgtccccctcaatccatcagcggagctgacggaaagcgtcgagaagctctctgagaccttgacccagcaaacgccggactatgtgagcacctatgtgaccggaccggctgggtttaccgctgatctcagcgcagctttcgcgggtattgatgggctactcctagcagtcgccttggctgccgtccttgtcattcttgtcatcgtctatcgctccttcattctgcccatcgccgtgcttgccaccagtttgtttgcgctgactgtagctctattggtggtgtggtggctagctaagtgggacatcctgctgctttcgggtcagactcaaggcatcctcttcattctggtcattggcgccgccaccgactactcattgctatacgttgctcgtttccgtgaagagttacgcgttcaacaagataaagggatagccacagggaaagccatccgggcatcggtggaacccattcttgcctcgggcagcactgttattgcgggcctcctttgtttgctatttagtgatttgaaatctaactccacgctaggtccagtagcttcggtgggcattatttttgcaatgctttctgctcttactctgctaccagccctgctgtttgtattcggtcgggtggccttttggcccaagcgaccaaaatacgaacctgaaaaagcccgtgcgaaaaacgacatccccgccagcgggatctggtcaaaagtggctgatttagtggagcagcatcctcgtgcaatctgggtatctacacttattgtgcttctcttgggtgcggctttcgttcccacactaaaagcggacggtgtgtcccaatccgacctagttctgggttcctctgaagcacgtgatggccagcaggctttaggcgaacacttccccggtggatccggcagtcctgcttatattatcgttgatgaaacacaggcagcacaggctgctgacgtagtccttaacaacgacaatttcgagactgtaactgtaactagtgctgactccccctctggctcagccccaatcaccgctgacggtattgtgccgttaggttctggtacagctccaggcccggtagttgtagaagggcaagtccttttacaagcaacacttgtcgaagcaccagattccgaagaagctcaaaaagctattcgcagtatccgccaaacttttgcagatgaaaatatatcagcggtagtaggcggtgtcactgcaacttccgtagacactaacgatgcctccatccatgaccgcaacctgatcatcccaattgtattgctggtcattttggttattctcatgctgttgctgcggtctattgtcgcaccactcctgctagtagtcaccaccgtggtgtcttttgctactgctttaggcgtggctgctttacttttcaatcacgttttcagtttcccaggagcagaccccgcagtacctctctacggatttgtatttttagtagccttgggcatcgactacaacattttcttagtcacccgaatccgtgaagaaaccaaaacccacggcacaagacttggaattcttcgaggcctgacagtaaccggcggagtaattacctcagctggagtagttctcgccgcaacgttcgcagcactctatgtcatcccaattctattcctggcacaaattgccttcattgtcgcttttggagttcttattgataccctgctcgttcgcgccttcttggtgcctgctttgttctacgacatcggaccgaaaatctggtggccgtcaaaattgtccaatcagaaataccagaagcagcctcagctatgacacaccaaaattcgcctctc

SEQ ID NO: 218 - protein, 730 aa, Corynebacterium glutamicum
MSTSITTENKKKSGPPRLMRIFLPALLILVWLVGAGVGGPYFGKVSEVSSNSQTTYLPESADATQVQEQLGDFTDSESIPAIVVMVSDEPLTQQDITQLNEVVAGLSELDIVSDEVSPAIPSEDGRAVQVFVPLNPSAELTESVEKLSETLTQQTPDYVSTYVTGPAGFTADLSAAFAGIDGLLLAVALAAVLVILVIVYRSFILPIAVLATSLFALTVALLVVWWLAKWDILLLSGQTQGILFILVIGAATDYSLLYVARFREELRVQQDKGIATGKAIRASVEPILASGSTVIAGLLCLLFSDLKSNSTLGPVASVGIIFAMLSALTLLPALLFVFGRVAFWPKRPKYEPEKARAKNDIPASGIWSKVADLVEQHPRAIWVSTLIVLLLGAAFVPTLKADGVSQSDLVLGSSEARDGQQALGEHFPGGSGSPAYIIVDETQAAQAADVVLNNDNFETVTVTSADSPSGSAPITADGIVPLGSGTAPGPVVVEGQVLLQATLVEAPDSEEAQKAIRSIRQTFADENISAVVGGVTATSVDTNDASIHDRNLIIPIVLLVILVILMLLLRSIVAPLLLVVTTVVSFATALGVAALLFNHVFSFPGADPAVPLYGFVFLVALGIDYNIFLVTRIREETKTHGTRLGILRGLTVTGGVITSAGVVLAATFAALYVIPILFLAQIAFIVAFGVLIDTLLVRAFLVPALFYDIGPKIWWPSKLSNQKYQKQPQL

SEQ ID NO: 219 - DNA, 983 bp, Corynebacterium glutamicum
  CDS (1)..(960): RXN03124
atgactcctaccctggcgtcgatgattggtctggctgtcggtatcgactacgcgctatttatcgtgtcccgtttccgcaatgagttgatttctcagactggcgctaatgatctggagccaaaggaattggctgagcgtctgcgcaccatgccgttggctgctcgtgcgcatgcgatgggaatggctgtgggcactgcgggttctgcggttgtattcgcgggtaccacggtgctgatcgctctggttgctctgtcgatcattaatattccatttctaaccgtgatggccattgctgccgcaatcaccgttgccatcgcagttctggttgctctgtccttcctcccagctctgcttggcctgcttggcactcgcatcttcgcagcacgcgtgcctggacctaaggttccggatcctgaggacgagaagccaacgatgggtctgaagtgggtccgccttgtgcgcaagatgccggtggcttacctgctggttggcgtcgttttgcttggtgcaatcgcaattcctgcgaccaatatgcgcctggccatgccgactgatggcacctccacgctgggcaccgcgccgcgcacggggtatgacatgacggcagatgcgttcggcccgggccgcaacgcgcccatgattgcgcttatcgacgcaaccgacgtccctgaggaagaacgcccattggtgtttggacaggcggtggagcaattcttgaacactgatggtgtgaagaatgctcagatcactcagaccacggagaatttcgataccgcgcagatcctgttaccccagaatttgatgcgatcgatgagcgcacctctgagactctcgcaactcttcgtgcagatgctgagaccttcgctgatgacaccggcgcgacgtatggcattactggcgtcaccccaatttacgatgacatctctgctcgcctcggcgacgtcctggttccttacgttctgatcgttttggttctagcgttc

SEQ ID NO: 220 - protein, 320 aa, Corynebacterium glutamicum
MTPTLASMIGLAVGIDYALFIVSRFRNELISQTGANDLEPKELAERLRTMPLAARAHAMGMAVGTAGSAVVFAGTTVLIALVALSIINIPFLTVMAIAAAITVAIAVLVALSFLPALLGLLGTRIFAARVPGPKVPDPEDEKPTMGLKWVRLVRKMPVAYLLVGVVLLGAIAIPATNMRLAMPTDGTSTLGTAPRTGYDMTADAFGPGRNAPMIALIDATDVPEEERPLVFGQAVEQFLNTDGVKNAQITQTTENFDTAQILLPQNLMRSMSAPLRLSQLFVQMLRPSLMTPARRMALLASPQFTMTSLLASATSWFLTF

SEQ ID NO: 221 - DNA, 762 bp, Corynebacterium glutamicum
  CDS (1)..(762): FRXA01180
atgactcctaccctggcgtcgatgattggtctggctgtcggtatcgactacgcgctatttatcgtgtcccgtttccgcaatgagttgatttctcagactggcgctaatgatctggagccaaaggaattggctgagcgtctgcgcaccatgccgttggctgctcgtgcgcatgcgatgggaatggctgtgggcactgcgggttctgcggttgtattcgcgggtaccacggtgctgatcgctctggttgctctgtcgatcattaatattccatttctaaccgtgatggccattgctgccgcaatcaccgttgccatcgcagttctggttgctctgtccttcctcccagctctgcttggcctgcttggcactcgcatcttcgcagcacgcgtgcctggacctaaggttccggatcctgaggacgagaagccaacgatgggtctgaagtgggtccgccttgtgcgcaagatgccggtggcttacctgctggttggcgtcgttttgcttggtgcaatcgcaattcctgcgaccaatatgcgcctggccatgccgactgatggcacctccacgctgggcaccgcgccgcgcacggggtatgacatgacggcagatgcgttcggcccgggccgcaacgcgcccatgattgcgcttatcgacgcaaccgacgtccctgaggaagaacgcccattggtgtttggacaggcggtggagcaattcttgaacactgatggtgtgaagaatgctcagatcactcagaccacggag

SEQ ID NO: 222 - protein, 254 aa, Corynebacterium glutamicum
MTPTLASMIGLAVGIDYALFIVSRFRNELISQTGANDLEPKELAERLRTMPLAARAHAMGMAVGTAGSAVVFAGTTVLIALVALSIINIPFLTVMAIAAAITVAIAVLVALSFLPALLGLLGTRIFAARVPGPKVPDPEDEKPTMGLKWVRLVRKMPVAYLLVGVVLLGAIAIPATNMRLAMPTDGTSTLGTAPRTGYDMTADAFGPGRNAPMIALIDATDVPEEERPLVFGQAVEQFLNTDGVKNAQITQTTE

SEQ ID NO: 223 - DNA, 393 bp, Corynebacterium glutamicum
  CDS (101)..(370): RXA02586
ttctctgagatcgtcatgatgaagtacatcgcgttcggcatgatcgcagcgctgattctggatgccaccatcatccgcatgctgcttgtcccccgccgtgatgcacctgcttcgcgacgacaactggtgggcacccggcttcgttaaaaaggcctacaccgtcatgggtcacggctctgaggtggaggaagcacctcgcccaaccacccgtcgcctcaacgacgatgaggaagtcaccgtgcatgaagcagttgtcgctggcgataccgtggcatctcgcggtggtttgagcacgcaggaaaaccgtgatctggtgtccttcgtggaacttaaggctcgtttggaaaagcgcaggcttgaggatctagattaaatctatgcgaggatttttca

SEQ ID NO: 224 - protein, 90 aa, Corynebacterium glutamicum
MHLLRDDNWWAPGFVKKAYTVMGHGSEVEEAPRPTTRRLNDDEEVTVHEAVVAGDTVASRGGLSTQENRDLVSFVELKARLEKRRLEDLD

SEQ ID NO: 225 - DNA, 2214 bp, Corynebacterium glutamicum
  CDS (101)..(2191): RXA02587
agcctggataacctgccagacggtggcgcatggctgcagccgttccgccctctgactgccttgttatccaaccgccacaattcccaggagtaatccacccgtgttttctaaatggggccactttgcttacagatttaggcgcattgttccgttagtcgtcatcgccgcgattttggctttgtttgtcattttcggcaccaagctgggcgaccgcatgagccaggaaggatgggatgatcctggttcttcctcgaccgctgcggcgcgcatcgagttggagacctttgggcgtgacaatgacggcgatgtcgtgttgctgtttactgcgcctgaaggcacttctttcgatgatgcagaggtgttctccagcatctctggctacttagatgggctaatcgagaacaaccctgatgaagtcagccacatcaacagctactttgacactcgtaatcaaaatctcctcagcaaagacggcacccaaacctttgcagctctcgggctcaaaggtgacggcgagcaaacgctgaaggacttccgggagattgaagatcagctccatccggacaaccttgccggtggcgtcaccactgaggtcgcgggtgccaccgctgtagccgacgcactcgatgagggcatggctggcgatatttcacgcgccgaagtttttgcgctgcctttcgtggctatcttgctgctcatcgtgtttggctcagttgttgccgcggcgatgccattgatcgtgggcattttgtccatcttgggttcgctgggcatcttggcaattttggctggattcttccaggtcaacgtatttgcacaatctgttgtgacccttctgggcttgggtcttgccattgactatggcttattcatggtctctcgtttccgtgaggaaatggataagggcaccccggttgaacaggctgttgccaccactacggcgaccgcgggtaagactgtggtgttctctgcagcgatggtggctgtggcgctgtccgggttgtttgttttcccacaggctttcttgaagtcggtggcattcggtgcgatttccgcggttggccttgctgctttgatgtcggtgacggtgttgccgtcgctgttcagcatgttgggtaagaatatcgataagtggagtttgcgtcgcactgctcgaacagcgcgccgtttggaagacaccatttggtaccgcgtgccggcatgggcaatgcgccatgccaaggcagtgaccgtgggcgtcgtattgctcttgcttgctcttacagtgccgttgacgggcgtgaaattcggcggcatcaatgaaacgtatctgccaccagctaacgacacccgcgtcgcccaagagcgtttcgacgaggcgtttcccgccttccgcaccgagccggtcaagcttgtggtcaccggggcggacaacaaccagctgatcgatatctatgttcaggccaacgaagttgagggactgacagatcgtttcaccgcaggtgcgactaccgatgatggcaccacggtgttgtctactggtattcaggatcgttccctcaatgagcaggtagtggagcagcttcgcgctatttccgtccctgagggcgttgaggtgcagatcggtggcactccagccatggagatcgaatccattgaggcgctctttgaaaagctcctctggatggctctctacattgtgctggccactttcatcctcatggcattggtatttggttcggtgattttgccggcgaaggccatcatcatgaccattctgggtatgggtgccaccttgggtattctcaccttgatgttcgtcgatggcgtgggtgccagcgcattgaacttctcccctggcccactgatgagtccagtgctggtgctgatcatggctattatttacggactttccaccgactatgaggtgttcctggtatctcgcatggtggaggcccgcgataaaggcgaatccaccgacgacgccatcagatacggcactgcacacaccggatctatcatcaccgcggccgcactgatcatgattgtggtctgtggagcgtttggtttctctgagatcgtcatgatgaagtacatcgcgttcggcatgatcgcagcgctgattctggatgccaccatcatccgcatgctgcttgtcccccgccgtgatgcacctgcttcgcgacgacaactggtgggcacccggcttcgttaaaaaggcctacaccgtcatgg

SEQ ID NO: 226 - protein, 697 aa, Corynebacterium glutamicum
VFSKWGHFAYRFRRIVPLVVIAAILALFVIFGTKLGDRMSQEGWDDPGSSSTAAARIELETFGRDNDGDVVLLFTAPEGTSFDDAEVFSSISGYLDGLIENNPDEVSHINSYFDTRNQNLLSKDGTQTFAALGLKGDGEQTLKDFREIEDQLHPDNLAGGVTTEVAGATAVADALDEGMAGDISRAEVFALPFVAILLLIVFGSVVAAAMPLIVGILSILGSLGILAILAGFFQVNVFAQSVVTLLGLGLAIDYGLFMVSRFREEMDKGTPVEQAVATTTATAGKTVVFSAAMVAVALSGLFVFPQAFLKSVAFGAISAVGLAALMSVTVLPSLFSMLGKNIDKWSLRRTARTARRLEDTIWYRVPAWAMRHAKAVTVGVVLLLLALTVPLTGVKFGGINETYLPPANDTRVAQERFDEAFPAFRTEPVKLVVTGADNNQLIDIYVQANEVEGLTDRFTAGATTDDGTTVLSTGIQDRSLNEQVVEQLRAISVPEGVEVQIGGTPAMEIESIEALFEKLLWMALYIVLATFILMALVFGSVILPAKAIIMTILGMGATLGILTLMFVDGVGASALNFSPGPLMSPVLVLIMAIIYGLSTDYEVFLVSRMVEARDKGESTDDAIRYGTAHTGSIITAAALIMIVVCGAFGFSEIVMMKYIAFGMIAALILDATIIRMLLVPRRDAPASRRQLVGTRLR

SEQ ID NO: 227 - DNA, 729 bp, Corynebacterium glutamicum
  CDS (101)..(706): RXN03042
atgacaccggcgcgacgtatggcattactggcgtaccccaatttacgatgacatctctgctcgcctcggcgacgtcctggttccttacgttctgatcgttttggttctagcgttcctcgtgctgttgctcgtgttccggtccatttgggtcccattgatcgcggctctgggctttggcttgtcagttctggctacctttggtgctaccgtggcgatcttccaagaaggtgctttcggcatcatcgacgatcctcagccactgctgtccttcttgccgatcatgctcatcggcctggtatttggtctggccatggattaccagatcttcctcgttactcgtatgcgtgagggcttcaccaagggcaagactgcgggcaacgcaacgtcgaatggtttcaagcacggtgcccgcgtggtcactgctgcggcgctgatcatggtgtctgtgttcgcggcattcatagcgcaggacatggcgtttattaagaccatgggctttgctctggccgttgctgtgttcttcgatgccttcgttgttcgcatgatgattatccctgcaacaatgttcctgcttgatgacaaggcttggtggctacctaagtggttggataagattcttcccaacgttgatgttgaaggtgagggtcttagtgaactacatgaggctcgcaccgaggaactgaaggaaaatgtaggtgtcggggcttagagaaacaaaaaaggctgcta

SEQ ID NO: 228 - protein, 202 aa, Corynebacterium glutamicum
LVLAFLVLLLVFRSIWVPLIAALGFGLSVLATFGATVAIFQEGAFGIIDDPQPLLSFLPIMLIGLVFGLAMDYQIFLVTRMREGFTKGKTAGNATSNGFKHGARVVTAAALIMVSVFAAFIAQDMAFIKTMGFALAVAVFFDAFVVRMMIIPATMFLLDDKAWWLPKWLDKILPNVDVEGEGLSELHEARTEELKENVGVGA

SEQ ID NO: 229 - DNA, 729 bp, Corynebacterium glutamicum; identical to SEQ ID NO: 227
  CDS (101)..(706): FRXA02893

SEQ ID NO: 230 - protein, 202 aa, Corynebacterium glutamicum; identical to SEQ ID NO: 228

SEQ ID NO: 231 - DNA, 1605 bp, Corynebacterium glutamicum
  CDS (101)..(1582): RXA01616
cctacgatttccgacgtcttaaatcgccacacagcgccgtggtctaaaacaccaacaaaagagttgtaactgtaccgaccattcgttacagttacgatccatgacttcagaaaccttacaggcgcaagcgcctacgaaaacccaacgttgggctttcctcgccgttatcagcggtggtctctttctgatcggtgtagacaactcgattctctacaccgcactccctctgctgcgtgaacagctcgcagcctccgaaacccaagcgttgtggatcatcaacgcatatcccctgctcatggcgggccttcgtttgggtgccggcactttgggtgacaaaaacggccaccgccggatgttcctcatgggcttgagcattttcggaatcgcttcacttggtgctgcgtttgctccaactgcgtgggctcttgttgctgcgagagctttccttggcatcggtgcggcaacgatgatgcctgcaaccttggctctgatccgcattacgtttgaggatgagcgtgagcgcaacactgcaattggtatttggggttccgtggcaattcttggcgctgcggcaggcccgatcattggtggtgcgctgttggaattcttctggtggggttcggttttcctcattaacgttccggtggctgttatcgcgttgatcgctacgctttttgtggcgccggccaatatcgcgaatccgtctaagcattgggatttcttgtcgtcgttctatgcgctgctcacacttgctgggttgatcatcacgatcaaggaatctgtgaatactgcacgccatatgcctcttcttttgggtgcagtcatcatgttgatcattggtgcggtgttgtttagcagtcgtcagaagaagatcgaggagccacttctagatctgtcgttgttccgtaatcgccttttcttaggcggtgtggttgctgcgggcatggcgatgtttactgtgtccggtttggaaatgactacctcgcagcgtttccagttgtctgtgggtttcactccacttgaggctggtttgctcatgatcccagctgcattgggtagcttcccgatgtctattatcggtggtgcaaacctgcatcgttggggcttcaaaccgctgatcagtggtggttttgctgccactgccgttggcatcgccctgtgtatttggggcgcgactcatactgatggtttgccgtttttcatcgcgggtctattcttcatgggcgcgggtgctggttcggtaatgtctgtgtcttccactgcgattatcggttccgcgccggtgcgtaaggctggcatggcgtcgtcgatcgaagaggtctcttatgagttcggcacgctgttgtctgtcgcgattttgggtagcttgttcccattcttctactcgctgcatgccccggcagaggttgcggataacttctcggcgggtgttcaccacgcgattgatggcgatgcggcgcgtgcatctttggacaccgcatacattaacgtgttgatcattgccctagtatgcgcagtagcggctgctctgatcagcagttaccttttccgcggaaatccgaagggagccaataatgcgcactagtaaaaaagagatgattctgc

SEQ ID NO: 232 - protein, 494 aa, Corynebacterium glutamicum
MTSETLQAQAPTKTQRWAFLAVISGGLFLIGVDNSILYTALPLLREQLAASETQALWIINAYPLLMAGLRLGAGTLGDKNGHRRMFLMGLSIFGIASLGAAFAPTAWALVAARAFLGIGAATMMPATLALIRITFEDERERNTAIGIWGSVAILGAAAGPIIGGALLEFFWWGSVFLINVPVAVIALIATLFVAPANIANPSKHWDFLSSFYALLTLAGLIITIKESVNTARHMPLLLGAVIMLIIGAVLFSSRQKKIEEPLLDLSLFRNRLFLGGVVAAGMAMFTVSGLEMTTSQRFQLSVGFTPLEAGLLMIPAALGSFPMSIIGGANLHRWGFKPLISGGFAATAVGIALCIWGATHTDGLPFFIAGLFFMGAGAGSVMSVSSTAIIGSAPVRKAGMASSIEEVSYEFGTLLSVAILGSLFPFFYSLHAPAEVADNFSAGVHHAIDGDAARASLDTAYINVLIIALVCAVAAALISSYLFRGNPKGANNAH

SEQ ID NO: 233 - DNA, 1500 bp, Corynebacterium glutamicum
  CDS (101)..(1477): RXA01666
cgacgcgcccctccaccttttcagtagcgtcacgggcgccaatcctgtatttttagcagcagtttgagggtttttgctccccatctttaggagacaccccgtgtccacgtttcataaagttttgatcaacaccatgatctccaacgtcaccactggatttctgttctttgccgtggtgttttggatgtatctttccactggcaacgtcgcactgaccggcatcgtcagtggaatttacatgggtttgatcgccgtttgttccatctttttcggaaccgttgttgatcacaatcgcaagaagtccgtcatgctgttttccagcgtcaccacactcgtgttttattgtctcagtgccctggtgtgggtgttttggctggaggaagacggcctgagcatcggaaataccgccctgtgggtgttcgtttctttcatcctcatcggatcaatcgtggaacacatgcgcaacatcgcactgtccaccgtggtcacgctgttggttcctgaagctgaacgcgacaaagcaaacggcctggtaggagccgtgcaaggtgttggatttttagtcaccagcgtcattgctggttccgccatcgggttcttgggcatggaaatcaccctgtggatctgccttgggctctcacttgtcgcgctgctgcacctgctgccgattcgcgtcgacgaaccggaaatcatcacccaagaagacgcacagcctactgtttctgacgattcagttcccacacctacctccgatttggcgatcgtgtccaaaggcatcgacctaaaaggatcaatgaaaatcatcctgagtgttccgggactgctcgcgcttgtgttgtttgcgtccttcaacaacctcatcggcggcgtgtactccgcactcatggacccttacggcctggaacttttcagcccacagctgtgggggctactgcttggactcaccagcctcggcttcatcgttggtggtgctgtgatctccaaaactggcttgggcaaaaaccctgtgcgcaccttgctgctggttaatgttggtgtggcttttgttggcatgttatttgccattcgcgaatggtggtggctctacatcctgggcattttcatcttcatggctatcaccccagctgccgaagccgcagaacaaaccatccttcaacgagtcgtcccattccgccaacaaggccgcgtatttggactagccatggcagtggaaatggcagccaacccgctctccacagtgatcgtggcgattttggccgaagcctacctcattccatggatggctggccccggcgcggacaccatctggggcgtgatcctcggcgagggtaaagctcgcggcatggcactgatgttcctcgcatcaggtgccatcatgttggttgtcgtgctgttggcattcatgtcgaggtcctaccggaaactcagccagtactacgccaccaccagccaagacattgcgggagctgctgagaagtaagtgctctagaccgttgtttg

SEQ ID NO: 234 - protein, 459 aa, Corynebacterium glutamicum
VSTFHKVLINTMISNVTTGFLFFAVVFWMYLSTGNVALTGIVSGIYMGLIAVCSIFFGTVVDHNRKKSVMLFSSVTTLVFYCLSALVWVFWLEEDGLSIGNTALWVFVSFILIGSIVEHMRNIALSTVVTLLVPEAERDKANGLVGAVQGVGFLVTSVIAGSAIGFLGMEITLWICLGLSLVALLHLLPIRVDEPEIITQEDAQPTVSDDSVPTPTSDLAIVSKGIDLKGSMKIILSVPGLLALVLFASFNNLIGGVYSALMDPYGLELFSPQLWGLLLGLTSLGFIVGGAVISKTGLGKNPVRTLLLVNVGVAFVGMLFAIREWWWLYILGIFIFMAITPAAEAAEQTILQRVVPFRQQGRVFGLAMAVEMAANPLSTVIVAILAEAYLIPWMAGPGADTIWGVILGEGKARGMALMFLASGAIMLVVVLLAFMSRSYRKLSQYYATTSQDIAGAAEK

SEQ ID NO: 235 - DNA, 1521 bp, Corynebacterium glutamicum
  CDS (101)..(1498): RXA00062
cttcaacataggcgttggggctgacttttaaacaggtaccagtagtaccggcataagcgatcactgttgcgttttcttgctgccatcaaaaattagtcacatgattttaagcatcgtccttttgggctacttcatgattctgcttgacacctccatcgtcattacgggtctacctgccatcggcagtgaacttggcatcgatcccgtgcacctgtcatgggtgcagagttcctacacattagtcttcggcgcacttcttctgctgggagctcgtgccggtgatatcttcggccgaaagaaagtgctctacattggtctcgcgttgtttgcggcttcatcgttggcaattgcgctttctccaaatgctgcggtcctcattggagcacgcgtagttcaaggcgcgggagctgcgattatcgctccagcgacacttgcgttgattactgagttcttccccgaaggcccagctcgccttcgtgctacctctgcttatggtgctgttgccggcatcggtgtggcagcaggcctagtgatcggcggcgtatttgctgatcttttgtcgtggcgcatcggcttctttatcaacgtccccatcgccgcagtgttggcctacatagtgcacaaagccattcccgcaaccttcagcaggcctggatcactcgacatcttcggagcaattacctccacggcaggtatcgccgcggtgctctacgcaattgtccgcagcgccgattacagctggacagatccgtttgtgttgatttccctcgtgctgggcatcgcagtgttcatctggttcctgcgccatgaatcctcagccaaagaaccacttctgcccctggggctctttaaaaaccgcaggcgaaacaccatcttggccagccgctttcttctggttggctccgtgatgtcattcttcttctttgccacccagctgttccaggacaccatgggaatgaatgctctccaggcaggccttgcgttcatgccgctatctctgctgcagtttgccagcgccgcgatggtgccacggctttcccgagcaggcgtatctgattccatgctcaccgtcatcggtttcgccatcatggtcatcggcatggcaggcctcgcatttgtaccaaacacgatgatcgcgctgatcctaccaatagttttggtgggatttggccaaggcttcgctttcggaccaatgacagctctggcagttcaaggtgcaccgaaggaccaatccggcgccgtttctggcctggtgaattcccttcaccaaatcggcggcaccttcggtttgggtgtgttctcctccttggctgtcgctgtcatcggacatgatgcaacatcagagatgatcagcgaccgcgcacacttcggattcttgctctccaccgtgacgctgacgctggccaccatctttgcggtcacactgctgaagcgccacgaaacccgaaagagtagcgagcgcccaacccagctcgtcgacgaaaaggcagttacctcttagtgcgctgcagcatcccagtt

SEQ ID NO: 236 - protein, 466 aa, Corynebacterium glutamicum
MILSIVLLGYFMILLDTSIVITGLPAIGSELGIDPVHLSWVQSSYTLVFGALLLLGARAGDIFGRKKVLYIGLALFAASSLAIALSPNAAVLIGARVVQGAGAAIIAPATLALITEFFPEGPARLRATSAYGAVAGIGVAAGLVIGGVFADLLSWRIGFFINVPIAAVLAYIVHKAIPATFSRPGSLDIFGAITSTAGIAAVLYAIVRSADYSWTDPFVLISLVLGIAVFIWFLRHESSAKEPLLPLGLFKNRRRNTILASRFLLVGSVMSFFFFATQLFQDTMGMNALQAGLAFMPLSLLQFASAAMVPRLSRAGVSDSMLTVIGFAIMVIGMAGLAFVPNTMIALILPIVLVGFGQGFAFGPMTALAVQGAPKDQSGAVSGLVNSLHQIGGTFGLGVFSSLAVAVIGHDATSEMISDRAHFGFLLSTVTLTLATIFAVTLLKRHETRKSSERPTQLVDEKAVTS

SEQ ID NO: 237 - DNA, 1584 bp, Corynebacterium glutamicum
  CDS (101)..(1561): RXA00215
cagtgcaaactgaccccgcatcctaaaccgcgccagatttctacctcaaagaattgaaggccttttccaggcgccctcgtgcgtgaaagaataactcaacgtgtctgacaaaaagcaggatctaacatcctccgcagcaggtagtgctgcaccccaaaccaaggcctaccccgccatgcccttgcctgaaaagcaagcttggccagctctaattgccttgtgcattgggtttttcatgatcctgttggatcaaaccatcgtggccgtctctaccccagcgttacaggcagacatgggcgcgtcctacaacgaggtcatctgggtaacctcggtgtatctcctcactttcgcggtgccactgcttgttactggccgtttgggcgacaagtacggtccgaaaaatgtctatgtcgcaggcatggttatcttcacagtgagctctttggcctgtggtttggccccagacatgttcacgttgattatcgctcgtggcgttcaaggtttgggcgcagcccttttgactccacaaaccatggcaacaatcaaccgcatctttgcttttgagcgccgcggtgcagctcttggagtgtggggttctacagctggccttgcatccctagcaggaccgatcctgggtggtgtcatcaccgaaaactggggttggcaatgggtcttctacatcaacgtgcccatcggcgtgatctcggtgatcgcagtaatgaagtacgttcctgaattcccaccgctgacccgaccgcttgatccgctttctatcgtgttgtccatcgtggccgtgttcttcctggtgtttgctttccaggaaggcgaaggcgctggctgggcggcatgggtgtggatcatgatcgtagccgcctttgcgctctttgcgtggtttatctaccaacaaagcagggccgagaaatccggaaacgatcctctcgtcccactggagattttcaagtttagaaacttcagcctcggcaatatctgcatcatggccatgggattcaccgtggctggtactcctctgcccatcatgttgtacttccagcaagcacacggaatgaacgccatggaagcgggtttcatgatggtgcctcaagctctcatggcagcagtactgtcaccatttgttggaaagctggttgatcgatccaaccctggactcatggcagccctcggttttagcacagtggctgtgtccattgtactgctgtcaatggtaatgattttcgatacgggtctagtctgggcacttgtttcgatgactttgctcggcatcggaaacgcctttgtgtgggcaccgaactcgacctccactatgcgcgacctgccacacaagttcatgggagcgggctctggcgtgttcaatacaacccgccaattaggttcagtcatcggcgccgctgccatcggcgcggtaatgcagattcgactggcagcaggcgatgagggcgcagcttttggtcaagcacttctacttgccgctgcggtgctggttatcggcattgtggcatcaacgatggcaggaaaaaatgcacacccagcgccggtaaagccttaaaggtcgcatgaatccttcga

SEQ ID NO: 238 - protein, 487 aa, Corynebacterium glutamicum
VSDKKQDLTSSAAGSAAPQTKAYPAMPLPEKQAWPALIALCIGFFMILLDQTIVAVSTPALQADMGASYNEVIWVTSVYLLTFAVPLLVTGRLGDKYGPKNVYVAGMVIFTVSSLACGLAPDMFTLIIARGVQGLGAALLTPQTMATINRIFAFERRGAALGVWGSTAGLASLAGPILGGVITENWGWQWVFYINVPIGVISVIAVMKYVPEFPPLTRPLDPLSIVLSIVAVFFLVFAFQEGEGAGWAAWVWIMIVAAFALFAWFIYQQSRAEKSGNDPLVPLEIFKFRNFSLGNICIMAMGFTVAGTPLPIMLYFQQAHGMNAMEAGFMMVPQALMAAVLSPFVGKLVDRSNPGLMAALGFSTVAVSIVLLSMVMIFDTGLVWALVSMTLLGIGNAFVWAPNSTSTMRDLPHKFMGAGSGVFNTTRQLGSVIGAAAIGAVMQIRLAAGDEGAAFGQALLLAAAVLVIGIVASTMAGKNAHPAPVKP

SEQ ID NO: 239 - DNA, 1455 bp, Corynebacterium glutamicum
  CDS (101)..(1432): RXN03064
tggagccttgtcttcctccagcaatcccacaacggagcaggttgggatcccgagaaatgttgtcatcatcttggctgtattagtttttacagcctttgtcatgatgttgaatgagactactctggcagtcgcgttgccgtcgatcatggcggactttgacattgaggcgaatactgcgcagtggttgctcactggttttatgttgaccatggctgtggttcttccagctactggttggatgttggaacgttttaccactcgtagtgtgtttattttcgccacggtggtcttcctgatcggtactgtgacggctgcgttgtctcctacttttgcgattatgcttgcagcccgcgtcgctcaggcgattggtaccgctgtgatcatgccgctgctgatgactgtcgcgatgaccgttgttcctccagagcgccgtggcgccgtcatgggtttgattgcggtcgtgatggccgttggtcctgctcttggacctagtgtggctggtttcgtactcagcttgtcttcgtggcacgcgattttctgggtcatggttccgttggtgtttgtggcaagcctgatcggtaccctgcgtctgaccaacgtcagtgagcctaaaaagactcctttggatgttatttccttcctgatttccgcagtggctttcggtggccttgtgtacgccttgagctcgattggcatcattttggaaggtgacagaagcgctttggtcgtgttggctgtcggcatcattgcgttggtggtgtttgtgtggcgccagattgccatgggtaagcaggataaggcgctgttggatctgcgtccgttggcgattcgtgagtacaccattccgctggttgtgcttttgacgctgttcggtgcgctgctcggtgtcatgaatacactgccgctctacctgcagggatccttgatggtcaccgccttggtcgcgggtctagtgctgttgccaggtggtcttttggaaggtgtgctgtcgccatttgtgggtcgaatttatgatcgtcatggtccacgcggactcgtgatcggcggtatgtcactcgttgtgatctccctgtttgcactgtccaccgtcgatgagttcgccaacgtgtggttcatcatcggcgtacacatcgtgttctccatcggccttgcgctgctgttcaccccactgatgacagtcgcgctcgcatccgtccccgacaacatgtacggccacggctccgcgatcctcaacaccctccaacagctcgccggcgccgcaggcaccgcggtcatgattgcggtttattccaccgtcagcaacaacgcgcttatcgacggcgcaacccaacaaaccgccctcgccgacggcgccaactctgcattcttcgcctcagcgtgcgtggcagtgtttgcactgatcgtgggcttctttgtaaagaggccagcccgctaagctaggtcgcatgatcagca

SEQ ID NO: 240 - protein, 444 aa, Corynebacterium glutamicum
MMLNETTLAVALPSIMADFDIEANTAQWLLTGFMLTMAVVLPATGWMLERFTTRSVFIFATVVFLIGTVTAALSPTFAIMLAARVAQAIGTAVIMPLLMTVAMTVVPPERRGAVMGLIAVVMAVGPALGPSVAGFVLSLSSWHAIFWVMVPLVFVASLIGTLRLTNVSEPKKTPLDVISFLISAVAFGGLVYALSSIGIILEGDRSALVVLAVGIIALVVFVWRQIAMGKQDKALLDLRPLAIREYTIPLVVLLTLFGALLGVMNTLPLYLQGSLMVTALVAGLVLLPGGLLEGVLSPFVGRIYDRHGPRGLVIGGMSLVVISLFALSTVDEFANVWFIIGVHIVFSIGLALLFTPLMTVALASVPDNMYGHGSAILNTLQQLAGAAGTAVMIAVYSTVSNNALIDGATQQTALADGANSAFFASACVAVFALIVGFFVKRPAR

SEQ ID NO: 241 - DNA, 1093 bp, Corynebacterium glutamicum
  CDS (101)..(1093): FRXA00565
tggagccttgtcttcctccagcaatcccacaacggagcaggttgggatcccgagaaatgttgtcatcatcttggctgtattagtttttacagcctttgtcatgatgttgaatgagactactctggcagtcgcgttgccgtcgatcatggcggactttgacattgaggcgaatactgcgcagtggttgctcactggttttatgttgaccatggctgtggttcttccagctactggttggatgttggaacgttttaccactcgtagtgtgtttattttcgccacggtggtcttcctgatcggtactgtgacggctgcgttgtctcctacttttgcgattatgcttgcagcccgcgtcgctcaggcgattggtaccgctgtgatcatgccgctgctgatgactgtcgcgatgaccgttgttcctccagagcgccgtggcgccgtcatgggtttgattgcggtcgtgatggccgttggtcctgctcttggacctagtgtggctggtttcgtactcagcttgtcttcgtggcacgcgattttctgggtcatggttccgttggtgtttgtggcaagcctgatcggtaccctgcgtctgaccaacgtcagtgagcctaaaaagactcctttggatgttatttccttcctgatttccgcagtggctttcggtggccttgtgtacgccttgagctcgattggcatcattttggaaggtgacagaagcgctttggtcgtgttggctgtcggcatcattgcgttggtggtgtttgtgtggcgccagattgccatgggtaagcaggataaggcgctgttggatctgcgtccgttggcgattcgtgagtacaccattccgctggttgtgcttttgacgctgttcggtgcgctgctcggtgtcatgaatacactgccgctctacctgcagggatccttgatggtcaccgccttggtcgcgggtctagtgctgttgccaggtggtcttttggaaggtgtgctgtcgccatttgtgggtcgaatttatgatcgtcatggtccacgcggactcgtgatcggcggtatgtcactcgttgtgatctccctgtttgcactgtccaccgtcgat

SEQ ID NO: 242 - protein, 331 aa, Corynebacterium glutamicum
MMLNETTLAVALPSIMADFDIEANTAQWLLTGFMLTMAVVLPATGWMLERFTTRSVFIFATVVFLIGTVTAALSPTFAIMLAARVAQAIGTAVIMPLLMTVAMTVVPPERRGAVMGLIAVVMAVGPALGPSVAGFVLSLSSWHAIFWVMVPLVFVASLIGTLRLTNVSEPKKTPLDVISFLISAVAFGGLVYALSSIGIILEGDRSALVVLAVGIIALVVFVWRQIAMGKQDKALLDLRPLAIREYTIPLVVLLTLFGALLGVMNTLPLYLQGSLMVTALVAGLVLLPGGLLEGVLSPFVGRIYDRHGPRGLVIGGMSLVVISLFALSTVD

SEQ ID NO: 243 - DNA, 380 bp, Corynebacterium glutamicum
  CDS (1)..(357): FRXA02878
tgcctgtccaccgtcgatgagttcgccacgtgttggtcatcattcgcggacacatcgtggttctcatcggcccttgcgctgctgttcaccccactgatgacagtcgcgctcgcatccgtccccgacaacatgtacggccacggctccgcgatcctcaacaccctccaacagctcgccggcgccgcaggcaccgcggtcatgattgcggtttattccaccgtcagcaacaacgcgcttatcgacggcgcaacccaacaaaccgccctcgccgacggcgccaactctgcattcttcgcctcagcgtgcgtggcagtgtttgcactgatcgtgggcttctttgtaaagaggccagcccgctaagctaggtcgcatgatcagca

SEQ ID NO: 244 - protein, 119 aa, Corynebacterium glutamicum
CLSTVDEFATCWSSFADTSWFSSALALLFTPLMTVALASVPDNMYGHGSAILNTLQQLAGAAGTAVMIAVYSTVSNNALIDGATQQTALADGANSAFFASACVAVFALIVGFFVKRPAR

SEQ ID NO: 245 - DNA, 1533 bp, Corynebacterium glutamicum
  CDS (101)..(1510): RXA00648
gtttgccagctattgcatcttgcacaaaatgtgtaccatacacataatgtcatcgagtcctcccgaatcagccacaccacagatcaaatacggcctgctggtggtcactctcgcctcagctggtatcactgtttccctagcgcagaccctggttattccgatcattggtcggttgcccgagatcttcaacaccacggctgctaatgcctcttggatcattactgtgacgctgttggtgggcgcagtggcgactcctgtgatgggcaggcttgcagatatgtacggcaagaaaaagatgatgctcatctcacttgtcccgttcattcttggatcagtgatctgcgctgtgtcggtggatttgattccgatgatcatcggccgtggttttcaggggcttggctctggcctgattcctcttggcatttctctcatgcatgatttgttgccccgggagaaagcagggtctgccattgctttgatgagttcttccatgggcattggcggtgcactcggtctaccgctggctgctgctattgcccagtttgcgtcctggcgggtgctgttctggttcaccgctctggtagcgcttacagttggcgcggtcatttggaaggcgattcctgctagacccaggatcgtgaggagtggcggctttgattatttcggtgctctcggccttgcaatgggacttatcgcattgttgctcgcggtgtccaagggatcagaatggggctggagaagtgccctgaccattgggttattcgtggcagcgctggtgattttggtgggttggggctggttcgaaacccgccagaaatcccctttgattgatctgcgcaccactattcgggcgaccgtgttgatgacaaatattgcgtccatcctcatcggtttcaccatgtatggaatgaatctgatcctgcctcaggtcatgcagctgcctgtaattctgggctacggtctaggccagagcatgcttcagatgggcatctggctgatcccgatgggtctaggcatgatgttgatttcgaatgcaggtgcagccattagcgctgctcatggtcctcgtgtgacgctgacaattgcgggtgttgtgatcgcagtcggttatgcacttactgccacagtgttgttcactatcggcaaccgcacaccgggaggagatgcagacaacgcacttattttgaccaccctggtgctgttctcagtgtgtagtctcgtggtcggtatcggcattggcctggcatttggttccatgcctgccttgatcatgggtgccgtaccagccacggagaaagccgcagcgaatggtttcaactctcttatgcgttcactgggcaccaccggctcatcagctgtcatcggtgcagtgttggccggaatgatgagtggcggagtacccaccttagggggattcatgaccactctgatcatcggatgctgcgccgcgcttgtggctgcggtcatctcctatttcatccccaccacaaccactgtggtggaagcaaaataatcccggcagcgactcgacca

SEQ ID NO: 246 - protein, 470 aa, Corynebacterium glutamicum
VVTLASAGITVSLAQTLVIPIIGRLPEIFNTTAANASWIITVTLLVGAVATPVMGRLADMYGKKKMMLISLVPFILGSVICAVSVDLIPMIIGRGFQGLGSGLIPLGISLMHDLLPREKAGSAIALMSSSMGIGGALGLPLAAAIAQFASWRVLFWFTALVALTVGAVIWKAIPARPRIVRSGGFDYFGALGLAMGLIALLLAVSKGSEWGWRSALTIGLFVAALVILVGWGWFETRQKSPLIDLRTTIRATVLMTNIASILIGFTMYGMNLILPQVMQLPVILGYGLGQSMLQMGIWLIPMGLGMMLISNAGAAISAAHGPRVTLTIAGVVIAVGYALTATVLFTIGNRTPGGDADNALILTTLVLFSVCSLVVGIGIGLAFGSMPALIMGAVPATEKAAANGFNSLMRSLGTTGSSAVIGAVLAGMMSGGVPTLGGFMTTLIIGCCAALVAAVISYFIPTTTTVVEAK

SEQ ID NO: 247 - DNA, 1770 bp, Corynebacterium glutamicum
  CDS (101)..(1747): RXN01320
gtgaatggcacgacatgccacaaggcacgcaagctgatttccaagcctgctgtcgcaaagcaattaaaaatacttttcttcttagaggtggattttcagaatgacatcacaggtcaagccggacgacgaacgtccggtaacaacaatttcaaaaagtggtgcaccttcggcccacacctcagcaccatatggtgcagcagcaactgaagaagctgtcgaggaaaaaaccaaaggtcgcgttggatttatcatcgcagccctcatgttggcgatgcttcttagctccttgggtcagaccattttcggttctgccctgccaacgattgttggtgagcttggcggcgttaaccacatgacctgggtgattaccgccttcctcttgggccagaccatttcattgcctattttcggcaagttgggtgaccagtttggtcgcaaatacctcttcatgtttgccatcgcactgttcgtggtgggttccatcatcggtgctttggctcagaacatgaccaccttgattgtggctcgtgcactgcagggtatcgccggtggtggcttgatgattctttctcaggcaattaccgctgatgtcaccaccgcccgtgagcgtgcaaagtacatgggcatcatgggttccgttttcggactgtcctccatccttggcccattgcttggtggctggttcactgacggtccaggctggcgttggggtctgtggttgaacgttccaatcggcatcatcgcactggttgctatcgctgtgctgctgaaacttccagctcgtgaacgtggcaaggtctccgttgactggttgggaagcatcttcatggctatcgccaccaccgcatttgtcctcgcagtgacctggggtggcaatgaatatgagtgggcatcaccaatgatcatcggtttgttcatcacgacattggtcgctgcgatagtgttcgttttcgtcgaaaagcgtgctgttgacccactggtccccatgggccttttctcgaaccgcaacttcgtgctcaccgccgtcgccggtatcggcgtaggcctgtttatgatgggcaccatcgcgtacatgcctacctacctgcagatggttcatggtctgaacccaacgcaagctggtctgatgctgatcccaatgatgatcggcctgattggtacatccactgtggtgggcaacatcgtgtccaagactggcaagtacaagtggtacccattcatcggcatgctcatcatggtccttgccctagtactgctatcgacgctgacaccttcggcaagcttggctctcattggactgtacttcttcgtcttcggattcggcctgggctgtgcaatgcagattttggttctcatcgtgcagaactccttcccaatcaccatggttggcaccgcgaccggttccaacaacttcttccgccaaatcggtggagcagtaggttccgcactgatcggtggcctgtttatctccaacctgtccgaccgattcaccgaaaacgtccccgcagcagtggcttccatgggtgaagaaggcgcacaatacgcctcagcaatgtccgatttctccggtgcatccaacctcactccacaccttgttgaatcacttccacaagcactccgtgaagcaattcaactttcttacaacgacgccctgacaccaatcttcttggcgctcaccccgatcgcagtagtcgccgcgatcctcctctttttcatccgtgaagatcacctcaaggaaacgcacgaataatgacacacgaaacttccgtc

SEQ ID NO: 248 - protein, 549 aa, Corynebacterium glutamicum
MTSQVKPDDERPVTTISKSGAPSAHTSAPYGAAATEEAVEEKTKGRVGFIIAALMLAMLLSSLGQTIFGSALPTIVGELGGVNHMTWVITAFLLGQTISLPIFGKLGDQFGRKYLFMFAIALFVVGSIIGALAQNMTTLIVARALQGIAGGGLMILSQAITADVTTARERAKYMGIMGSVFGLSSILGPLLGGWFTDGPGWRWGLWLNVPIGIIALVAIAVLLKLPARERGKVSVDWLGSIFMAIATTAFVLAVTWGGNEYEWASPMIIGLFITTLVAAIVFVFVEKRAVDPLVPMGLFSNRNFVLTAVAGIGVGLFMMGTIAYMPTYLQMVHGLNPTQAGLMLIPMMIGLIGTSTVVGNIVSKTGKYKWYPFIGMLIMVLALVLLSTLTPSASLALIGLYFFVFGFGLGCAMQILVLIVQNSFPITMVGTATGSNNFFRQIGGAVGSALIGGLFISNLSDRFTENVPAAVASMGEEGAQYASAMSDFSGASNLTPHLVESLPQALREAIQLSYNDALTPIFLALTPIAVVAAILLFFIREDHLKETHE

SEQ ID NO: 249 - DNA, 841 bp, Corynebacterium glutamicum
  CDS (101)..(841): FRXA01314
gtgaatggcacgacatgccacaaggcacgcaagctgatttccaagcctgctgtcgcaaagcaattaaaaatacttttcttcttagaggtggattttcagaatgacatcacaggtcaagccggacgacgaacgtccggtaacaacaatttcaaaaagtggtgcaccttcggcccacacctcagcaccatatggtgcagcagcaactgaagaagctgtcgaggaaaaaaccaaaggtcgcgttggatttatcatcgcagccctcatgttggcgatgcttcttagctccttgggtcagaccattttcggttctgccctgccaacgattgttggtgagcttggcggcgttaaccacatgacctgggtgattaccgccttcctcttgggccagaccatttcattgcctattttcggcaagttgggtgaccagtttggtcgcaaatacctcttcatgtttgccatcgcactgttcgtggtgggttccatcatcggtgctttggctcagaacatgaccaccttgattgtggctcgtgcactgcagggtatcgccggtggtggcttgatgattctttctcaggcaattaccgctgatgtcaccaccgcccgtgagcgtgcaaagtacatgggcatcatgggttccgttttcggactgtcctccatccttggcccattgcttggtggctggttcactgacggtccaggctggcgttggggtctgtggttgaacgttccaatcggcatcatcgcactggttgctatcgctgtgctgctgaaacttccagctcgtgaacgtggcaaggtctccgttgactggttgggaagcatcttcatggctatcgccacc

SEQ ID NO: 250 - protein, 247 aa, Corynebacterium glutamicum
MTSQVKPDDERPVTTISKSGAPSAHTSAPYGAAATEEAVEEKTKGRVGFIIAALMLAMLLSSLGQTIFGSALPTIVGELGGVNHMTWVITAFLLGQTISLPIFGKLGDQFGRKYLFMFAIALFVVGSIIGALAQNMTTLIVARALQGIAGGGLMILSQAITADVTTARERAKYMGIMGSVFGLSSILGPLLGGWFTDGPGWRWGLWLNVPIGIIALVAIAVLLKLPARERGKVSVDWLGSIFMAIAT

SEQ ID NO: 251 - DNA, 803 bp, Corynebacterium glutamicum
  CDS (1)..(780): FRXA01320
gttgacccactggtccccatgggccttttctcgaaccgcaacttcgtgctcaccgccgtcgccggtatcggcgtaggcctgtttatgatgggcaccatcgcgtacatgcctacctacctgcagatggttcatggtctgaacccaacgcaagctggtctgatgctgatcccaatgatgatcggcctgattggtacatccactgtggtgggcaacatcgtgtccaagactggcaagtacaagtggtacccattcatcggcatgctcatcatggtccttgccctagtactgctatcgacgctgacaccttcggcaagcttggctctcattggactgtacttcttcgtcttcggattcggcctgggctgtgcaatgcagattttggttctcatcgtgcagaactccttcccaatcaccatggttggcaccgcgaccggttccaacaacttcttccgccaaatcggtggagcagtaggttccgcactgatcggtggcctgtttatctccaacctgtccgaccgattcaccgaaaacgtccccgcagcagtggcttccatgggtgaagaaggcgcacaatacgcctcagcaatgtccgatttctccggtgcatccaacctcactccacaccttgttgaatcacttccacaagcactccgtgaagcaattcaactttcttacaacgacgccctgacaccaatcttcttggcgctcaccccgatcgcagtagtcgccgcgatcctcctctttttcatccgtgaagatcacctcaaggaaacgcacgaataatgacacacgaaacttccgtc

SEQ ID NO: 252 - protein, 260 aa, Corynebacterium glutamicum
VDPLVPMGLFSNRNFVLTAVAGIGVGLFMMGTIAYMPTYLQMVHGLNPTQAGLMLIPMMIGLIGTSTVVGNIVSKTGKYKWYPFIGMLIMVLALVLLSTLTPSASLALIGLYFFVFGFGLGCAMQILVLIVQNSFPITMVGTATGSNNFFRQIGGAVGSALIGGLFISNLSDRFTENVPAAVASMGEEGAQYASAMSDFSGASNLTPHLVESLPQALREAIQLSYNDALTPIFLALTPIAVVAAILLFFIREDHLKETHE

SEQ ID NO: 253 - DNA, 1755 bp, Corynebacterium glutamicum
  CDS (101)..(1732): RXN02926
ccctgacaccaatcttcttggcgctcaccccgatcgcagtagtcgccgcgatcctcctctttttcatccgtgaagatcacctcaaggaaacgcacgaataatgacacacgaaacttccgtccccggacctgccgacgcgcaggtcgcaggagatacgaagctgcgcaaaggccgcgcgaagaaggaaaaaactccttcatcaatgacgcctgaacaacaaaagaaagtctggtgggtcctcagcgcgctgatggtcgccatgatgatggcctcccttgaccagatgattttcggcacagccctgccaacaatcgtcggtgaactcggcggcgttgaccacatgatgtgggtcatcaccgcatacctacttgccgaaaccatcatgctgccgatctacggaaagctcggcgacctggttggacgtaaaggtctcttcatcggagccctcggcatcttcctgatcggctccgtcatcggcgggcttgcaggaaatatgacctggttgatcgtcggccgtgccgtacagggcatcggtggcggtggactgatgatcctctcgcaggcaatcatcgcggacgttgttccagcacgtgaacgtggccgctacatgggtgtcatgggtggagtcttcggactctctgcagttcttggcccactactcggtggctggttcaccgaaggaccaggctggcgctgggcattctggatgaacatcccactgggaatcatcgccatcggtgtcgccatttacttcctggacattccaaagaagagcgtcaagttccgctgggattacctgggcactttcttcatgatcgttgccgcaaccagcctgatcctgttcaccacctggggtggatcccagtacgagtggtctgatccaatcatcattggactgatcatcaccaccatcgttgccgctgcactgctggttgttgtggaactgcgcgcaaaagatccattggttccaatgtccttcttccaaaaccgcaacttcacgctcaccaccattgcaggcctgatcctgggtatcgcaatgttcggcatcatcggctaccttccgacctacctccagatggtccacggaatcaacgccaccgaagccggctacatgctgatcccaatgatggtcggcatgatgggtacctccatctggactggtatccgcatctccaacacaggaaagtacaaactcttcccaccaatcggcatggtggttaccttcgtggcactgatcttctttgcccgaatggaagtgtccaccaccctgtggcagatcggaatctacctcttcgtcctcggcgtcggcctgggtctagccatgcaggttctggtcctgatcgttcagaacaccctgccaaccgcggtggtcggatccgcaaccgctgtgaacaacttcttccgtcaaatcggttcctcactcggatccgcgctggtcggtggcatgttcgttggcaacttgggaaccctcatggaagaaagaatgccagcagccatggcacaactttcaccagaagaacaagccgccatggcagcccaaggcggactggactccaacgaattgacgccggcaatcgtcaatcaattgccaaccgcgctccacgatgcgttcgccggttcctacaacgacgcactcatcccagtgttctacgtgatgatgccactgatcggcatcgcgctgcttctcttgctgtttattaagcaagaaaaactacgcgaaaccaccacagactaaacacaaaacaaatgagacct

SEQ ID NO: 254 - protein, 544 aa, Corynebacterium glutamicum
MTHETSVPGPADAQVAGDTKLRKGRAKKEKTPSSMTPEQQKKVWWVLSALMVAMMMASLDQMIFGTALPTIVGELGGVDHMMWVITAYLLAETIMLPIYGKLGDLVGRKGLFIGALGIFLIGSVIGGLAGNMTWLIVGRAVQGIGGGGLMILSQAIIADVVPARERGRYMGVMGGVFGLSAVLGPLLGGWFTEGPGWRWAFWMNIPLGIIAIGVAIYFLDIPKKSVKFRWDYLGTFFMIVAATSLILFTTWGGSQYEWSDPIIIGLIITTIVAAALLVVVELRAKDPLVPMSFFQNRNFTLTTIAGLILGIAMFGIIGYLPTYLQMVHGINATEAGYMLIPMMVGMMGTSIWTGIRISNTGKYKLFPPIGMVVTFVALIFFARMEVSTTLWQIGIYLFVLGVGLGLAMQVLVLIVQNTLPTAVVGSATAVNNFFRQIGSSLGSALVGGMFVGNLGTLMEERMPAAMAQLSPEEQAAMAAQGGLDSNELTPAIVNQLPTALHDAFAGSYNDALIPVFYVMMPLIGIALLLLLFIKQEKLRETTTD

SEQ ID NO: 255 - DNA, 1294 bp, Corynebacterium glutamicum
  CDS (101)..(1294): FRXA01319
ccctgacaccaatcttcttggcgctcaccccgatcgcagtagtcgccgcgatcctcctctttttcatccgtgaagatcacctcaaggaaacgcacgaataatgacacacgaaacttccgtccccggacctgccgacgcgcaggtcgcaggagatacgaagctgcgcaaaggccgcgcgaagaaggaaaaaactccttcatcaatgacgcctgaacaacaaaagaaagtctggtgggtcctcagcgcgctgatggtcgccatgatgatggcctcccttgaccagatgattttcggcacagccctgccaacaatcgtcggtgaactcggcggcgttgaccacatgatgtgggtcatcaccgcatacctacttgccgaaaccatcatgctgccgatctacggaaagctcggcgacctggttggacgtaaaggtctcttcatcggagccctcggcatcttcctgatcggctccgtcatcggcgggcttgcaggaaatatgacctggttgatcgtcggccgtgccgtacagggcatcggtggcggtggactgatgatcctctcgcaggcaatcatcgcggacgttgttccagcacgtgaacgtggccgctacatgggtgtcatgggtggagtcttcggactctctgcagttcttggcccactactcggtggctggttcaccgaaggaccaggctggcgctgggcattctggatgaacatcccactgggaatcatcgccatcggtgtcgccatttacttcctggacattccaaagaagagcgtcaagttccgctgggattacctgggcactttcttcatgatcgttgccgcaaccagcctgatcctgttcaccacctggggtggatcccagtacgagtggtctgatccaatcatcattggactgatcatcaccaccatcgttgccgctgcactgctggttgttgtggaactgcgcgcaaaagatccattggttccaatgtccttcttccaaaaccgcaacttcacgctcaccaccattgcaggcctgatcctgggtatcgcaatgttcggcatcatcggctaccttccgacctacctccagatggtccacggaatcaacgccaccgaagccggctacatgctgatcccaatgatggtcggcatgatgggtacctccatctggactggtatccgcatctccaacacaggaaagtacaaactcttcccaccaatcggcatggtggttaccttcgtggcactgatcttctttgcccgaatggaagtgtccaccaccctgtggcagatcggaatctacctcttc

SEQ ID NO: 256 - protein, 398 aa, Corynebacterium glutamicum
MTHETSVPGPADAQVAGDTKLRKGRAKKEKTPSSMTPEQQKKVWWVLSALMVAMMMASLDQMIFGTALPTIVGELGGVDHMMWVITAYLLAETIMLPIYGKLGDLVGRKGLFIGALGIFLIGSVIGGLAGNMTWLIVGRAVQGIGGGGLMILSQAIIADVVPARERGRYMGVMGGVFGLSAVLGPLLGGWFTEGPGWRWAFWMNIPLGIIAIGVAIYFLDIPKKSVKFRWDYLGTFFMIVAATSLILFTTWGGSQYEWSDPIIIGLIITTIVAAALLVVVELRAKDPLVPMSFFQNRNFTLTTIAGLILGIAMFGIIGYLPTYLQMVHGINATEAGYMLIPMMVGMMGTSIWTGIRISNTGKYKLFPPIGMVVTFVALIFFARMEVSTTLWQIGIYLF

SEQ ID NO: 257 - DNA, 1510 bp, Corynebacterium glutamicum
  CDS (93)..(1487): RXA01578
tgacctcccctcaaccactcactgaaaagagaacactgatgtcacttcctgttcagccgagtaaaacctcggccgccacagtcataccattgatgatcgccctgctggtcgcggtattcgccttccagctcaacgcctccatgctggcgccggcactggccaccatggaaactgaacttaatgcaacagctgcccaaatcggcatgacgcagactgctttcttcaccgcggcggcgctgttttccctgttcctgccacgttggggcgatctgattggtcgccgcaaagtgctggtcggcatgatgattgtcaccggtattggatgtgttgtcgctgcctttgctccgaatgtgaccatcctcttcctgggccgcctgattcaaggtgttgctggcccaaccgtgccactgtgtctgatcattctgcgccagcaggtaaccaatgaaaagcaatatgcgctacttctcggaattgttacctctgtcaacggtggtatcggcggcgtggacgcgcttgctggtggctggttggctgaaacacttggtttccgttccatcttctgggtcatggctgctttctgcgctgtcgctgccctcgcactgcctttcagcgtgaaggaatccaccgctgaagaaaccccgaagatggactggcttggtgtgctgccactggcggtgtccattggatctttgctcatggctttcaacgaggccggcaaactcggtgccgcgaactggattctggtggttgtgctgttcatcatcggtatcgccggagtcatcttcttctacaacattgaaaagcgcgttaagcacccgctggtcagtgttgaatacctcggtcaacgacgcacctgggcattgctgctgagcacccttctcacaatgaccggtgtattcgccgtaatgaatggtctgctgcccaaccttgcgcaggatgctgccaacggtgccggcatgtcagcgagcgtggtgtcctggtggacacttaccccatatgcgctggctggcttggtattcggtccaatcgccggaattctcgccggaaaatttggatacaagatcgtcctgcaaattggtatcgctgccaccatcatcggcgttgccggagccaccttcttagtcggaagcacctcgcatctcgcgtacctcggcatctccatcttcgtgggtattacctatgcaggtattgccaacatcatgctcaacggcctgggcatcgtgctctcccctgctaacaaccaaggctatctgcctggcatgaacgcaggtgccttcaacctaggtgcaggtatttccttcgccatcctcttcgcagtttccacggcattcagtgacaacggcggaggatacgccgcaggcatgtgggctggcgtgatcatcttggtcctagccttcctctgctccctgctgatcccacgcccagaatcaatcaccgatacagtggcagccaaagtccaggctgaagaagccgctcaagccgccagctaaatccacaaactgaactaagg

SEQ ID NO: 258 - protein, 465 aa, Corynebacterium glutamicum
MIALLVAVFAFQLNASMLAPALATMETELNATAAQIGMTQTAFFTAAALFSLFLPRWGDLIGRRKVLVGMMIVTGIGCVVAAFAPNVTILFLGRLIQGVAGPTVPLCLIILRQQVTNEKQYALLLGIVTSVNGGIGGVDALAGGWLAETLGFRSIFWVMAAFCAVAALALPFSVKESTAEETPKMDWLGVLPLAVSIGSLLMAFNEAGKLGAANWILVVVLFIIGIAGVIFFYNIEKRVKHPLVSVEYLGQRRTWALLLSTLLTMTGVFAVMNGLLPNLAQDAANGAGMSASVVSWWTLTPYALAGLVFGPIAGILAGKFGYKIVLQIGIAATIIGVAGATFLVGSTSHLAYLGISIFVGITYAGIANIMLNGLGIVLSPANNQGYLPGMNAGAFNLGAGISFAILFAVSTAFSDNGGGYAAGMWAGVIILVLAFLCSLLIPRPESITDTVAAKVQAEEAAQAAS

SEQ ID NO: 259 - DNA, 1470 bp, Corynebacterium glutamicum
  CDS (101)..(1447): RXA02087
aatcggattcatgctgtgtggtgtgatcagtttgctggctgcggtcgcatggatcttcggccgggagacgctgccaacggcgaaagtcgagcaggtataaatgacgccaattgtggagtccagggcgtggaaagctctgggcgctttaagtgttgggctgtttctcacactgcttgaccaatcgttggtggctgtcgcgctgccaaagattcaagaggatttgggtgcgagcctgaaccaagcggtgtgggtgtcagcggtttatttgctcacttttgcggtgccactgttgattactgggcgcttgggtgatcgttatggacagcgaaatatttatcttgccggcatggctgtgtttaccctcgcggcgttggcctgtgtatttgcaccaagcatcgaatggttgattgctgctcgcgcggtgcagggcctgggcggatctcttcttaatccgcagcccctgagcatcattcacaagattttcgcgcatgatcgtaggggagccgccaccggggtgtggagtgctgttgcctcatcagctggacttttcgggccagttatcggtggtgttctggtggggtggatcagctggcgtgctgtgttcttggtttatgtgccgctcggattgatctccctatttatggtggcgcgttatgtgcctaaacttcccacgggaacctcgaagatcgattggctctcgggtgcggtctcacttgttgctgtacttggtgtggttcttgccttgcagcaggggccagaacttgggtggggaacactgatttgggtgtcccttgccgttggtattgctgcagctgtgctctttatatggatgcaaacaagatccaaggcgccactgatgccgttgaggattttcaagacgcgcaacttcgcgatcggtgcattttcgatcttcagcctgggctttacggtgtattccgttaatttgcccatcatgttgtatctgcaaacggctcagggaatgtcgtcgcagttggccggtttgatgttggttccgatgggcatcatctctgtggtgatgtcaccagtaattggacgattggtggatcgcctggcaccaggaatgatctccaagatcggattcggcgcgctgattttctcgatggcgttgatggctgtctttatgatcgccaacctatcgccgtggtggctactcatcccgattattttgttcggtagctccaacgcgatgagttttgcaccgaactctgtgattgctctgcgtgatgttccgcaggatttagtgggctctgcttctggtttttacaacacctcacgccaggtgggcgctgttttgggcgccgctaccttgggcgctgtgatgcaaataggagtgggcacggtgtccttcggtgttgccatgggtgcggcaatcctggtgacactcgtgcccttaatctttgggttcctagcggtaacccaatttagatagttgctccgattttctcacga

SEQ ID NO: 260 - protein, 449 aa, Corynebacterium glutamicum
MTPIVESRAWKALGALSVGLFLTLLDQSLVAVALPKIQEDLGASLNQAVWVSAVYLLTFAVPLLITGRLGDRYGQRNIYLAGMAVFTLAALACVFAPSIEWLIAARAVQGLGGSLLNPQPLSIIHKIFAHDRRGAATGVWSAVASSAGLFGPVIGGVLVGWISWRAVFLVYVPLGLISLFMVARYVPKLPTGTSKIDWLSGAVSLVAVLGVVLALQQGPELGWGTLIWVSLAVGIAAAVLFIWMQTRSKAPLMPLRIFKTRNFAIGAFSIFSLGFTVYSVNLPIMLYLQTAQGMSSQLAGLMLVPMGIISVVMSPVIGRLVDRLAPGMISKIGFGALIFSMALMAVFMIANLSPWWLLIPIILFGSSNAMSFAPNSVIALRDVPQDLVGSASGFYNTSRQVGAVLGAATLGAVMQIGVGTVSFGVAMGAAILVTLVPLIFGFLAVTQFR

SEQ ID NO: 261 - DNA, 1338 bp, Corynebacterium glutamicum
  CDS (101)..(1315): RXA02088
agagcacccaagcgacattgttcgataatatgttctattattggtattaatactggtcagctagatataaaaggggcgcagggctagccttgggtgtgaaatgttaactcaaaaaatagaattagaggctaaaccaaaaatcccagaggagatctgggtgctggttgtggctgcgtttattattgcgctgggctatggcctgattgcgccgattttgccacagtttgtggtcggttttgatgtaagttttgcagctgccagtgcggtggtgtccatctttgcgggcgcccggttgttgtttgcgccgatgtcggggagtttgatcgataagatcggttcccgtcgtgtgtatctcactggtttactcaccgtggctatcaccacggggcttgttgcgttggcgcaggaatactggcagattctgctgcttcgtggcatcgcaggtattggttccaccatgtttacggtctctgccatgggcctgatcgtgaagatggcgccggtggagatccgcgggcggtgttcgtcggtatatgccagttcgttcctgtttggcaatattattggcccggttgtgggtgctgcgatgtccggtttgggcatgcggtggccgttcgcgatttatggtgcttccgttggcttagctgcacttgttgtgtggtggcggatgccgaaaaccaacgattcacttcggaaggctgatagcaatagtgtgccggcgttgcgctttgctgaggcaattaaggattctgcctaccgctcggcgttgtttagtgcttttgccaatggttggtcgaactttggtgtgcgtgtggcggttcttccactgtttgccgcagctgcatttagcaatggcggagctattgcgggttttgccatggctgcgttcgccgctggaaatgctttgtgtctgcaattcgcgggcgatctctcagatcgcattggccgtaaaccgatgattatttccgggctgatcgtcaatgcagtgttcacggcaatgatcggattcggcacagaagtgtggatcctgatcacggtatctgcgttggcaggtgctggtgcgggcttgcttaatccaagtcagcaggcggtgctcgctgatgttatagattcccgccccggcggaaaagtcttagcgaatttccaaatggcgcaggatttcggtgcgattgttggcccgattctcgtaggcatgatcgcagaacaggcaggcttccaaatcggattcatgctgtgtggtgtgatcagtttgctggctgcggtcgcatggatcttcggccgggagacgctgccaacggcgaaagtcgagcaggtataaatgacgccaattgtggagtc

SEQ ID NO: 262 - protein, 405 aa, Corynebacterium glutamicum
MLTQKIELEAKPKIPEEIWVLVVAAFIIALGYGLIAPILPQFVVGFDVSFAAASAVVSIFAGARLLFAPMSGSLIDKIGSRRVYLTGLLTVAITTGLVALAQEYWQILLLRGIAGIGSTMFTVSAMGLIVKMAPVEIRGRCSSVYASSFLFGNIIGPVVGAAMSGLGMRWPFAIYGASVGLAALVVWWRMPKTNDSLRKADSNSVPALRFAEAIKDSAYRSALFSAFANGWSNFGVRVAVLPLFAAAAFSNGGAIAGFAMAAFAAGNALCLQFAGDLSDRIGRKPMIISGLIVNAVFTAMIGFGTEVWILITVSALAGAGAGLLNPSQQAVLADVIDSRPGGKVLANFQMAQDFGAIVGPILVGMIAEQAGFQIGFMLCGVISLLAAVAWIFGRETLPTAKVEQV

SEQ ID NO: 263 - DNA, 1239 bp, Corynebacterium glutamicum
  CDS (101)..(1216): RXA00764
tactgcgtcggatccgctgatgcttgcagaatcggacagtgatgggccgtctgcgcctgcacctgggacgactggattattaggggtggaattttcgctcatgacactcaagactagcgttttggcactactcttagataacgtgcatgttcttctgattgcgaatcctgagtcgaccacgcagacgcagaaacttttccgtcgtgtggtgcctgcgttgatggcgcttgatggtgtgtcgcttgaagcgaggtttacgcactatggaggccatgcggaggaaatggttgcgggtttgacggtggatgattttgatgtgattatccccgcgggtggggacggcaccgtcaacgaagtgataaatgggttacttgggtcggcggaaggtgattttagaaaccttgaggatttgccggcgattgcggtgttgccaacggggtctgccaatgtgtttgcccgtgcgcttggttaccccactgacccgtatgctgccgctgatgccctggtggagttgattcggaagaaccacaccagaactatcaccttgggtacgtggaagggtgatgatcaggggactcgttggttcgcggttaatgctgggtttggtattgatgcggatgttattgccagggtcgaacgggcgagatctttcggctttgcggcttcaccgttgttgtatctgcaggtgagtcttcgggcgtgggtgaaaactcagattaagccaccgaaaattaccgtggaggcggtggacagcaaagggcacaaattgcaaaaagaggaagtgccaatgctgcttgcctcgaataccaatccgtggacttttttgggtccgcttcctgtggtgacaaatccgcagaattcttttgacacaggtctggggctttttggcttgactagtgtgcgaggattcgggggagtggcagcgatgatgcacctgattggcgtggggcatggtcggaagttggagaagttgatcgctaagcgcaccattgcttttgatgatgcggagaaagtaacgctcacgtgcgacagcgatcagcgtttccaagttgatggtgagtatgaaggcaaaccaacaaaggtggtgttggaatcaatcactgatgcggtgcgagtgtatgcgccgaagacgcatccgacaccgccgatcatgaattgggctgtccatttgtttaagcacgtccgtgatttcctccgggtgcgcacgtttggcatctaggattcatcggagttttcttc

SEQ ID NO: 264 - protein, 372 aa, Corynebacterium glutamicum
MTLKTSVLALLLDNVHVLLIANPESTTQTQKLFRRVVPALMALDGVSLEARFTHYGGHAEEMVAGLTVDDFDVIIPAGGDGTVNEVINGLLGSAEGDFRNLEDLPAIAVLPTGSANVFARALGYPTDPYAAADALVELIRKNHTRTITLGTWKGDDQGTRWFAVNAGFGIDADVIARVERARSFGFAASPLLYLQVSLRAWVKTQIKPPKITVEAVDSKGHKLQKEEVPMLLASNTNPWTFLGPLPVVTNPQNSFDTGLGLFGLTSVRGFGGVAAMMHLIGVGHGRKLEKLIAKRTIAFDDAEKVTLTCDSDQRFQVDGEYEGKPTKVVLESITDAVRVYAPKTHPTPPIMNWAVHLFKHVRDFLRVRTFGI

SEQ ID NO: 265 - DNA, 271 bp, Corynebacterium glutamicum
  CDS (101)..(271): RXN03125
tgacaccggcgcgacgtatggcattactggcgtcaccccaatttacgatgacatctctgctcgcctcggcgacgtcctggttccttacgttctgatcgttttggttctagcgttcctcgtgctgttgctcgtgttccggtccatttgggtcccattgatcgcggctctgggctttggcttgtcagttctggctacctttggtgctaccgtggcgatcttccaagaaggtgctttcggcatcatcgacgatcctcagccactgctgtgcttc

SEQ ID NO: 266 - protein, 57 aa, Corynebacterium glutamicum
LVLAFLVLLLVFRSIWVPLIAALGFGLSVLATFGATVAIFQEGAFGIIDDPQPLLCF

SEQ ID NO: 267 - DNA, 1443 bp, Corynebacterium glutamicum
  CDS (101)..(1420): RXN01553
atgatgatgtcctcagcaagtccaagcgccaagccatgctggaaacaattctcgagctgataccaagccagacttaaatttctaccttaaagtcttgagcatgactgttcaggaattcgaccgcgcgaccaaacccacaccaaaacccccaattgtttcttgggcgttttgggattggggttccgcctctttcaacgcggtcctcgtgacctttattttctcggtctatctcactgattcagtcggcgccaccctccccgagggttccaacgccacatcactgtattcgatggcggtcgccatcgctggcgtcattgttgcggttgttgccccagtcatgggcaggcgatcagatatcaagggcactcgccgcaggtcactgcgcatgtggacacttgtcaccgtgttcttgatgttttgtctctttacagtaaagaacactgatcccacatttttctggtttggtgtagccatcatggcgatcgccaacatcacctttgagttcgctgaagttcagtactatgcgcagctctcccaaatctcgacccgcgaaaacgtgggccgagtttctggtttcggctggtccatgggttacttcggtggcatcgttctactgcttgtttgttacctaggttttgttgccggtgatggcgatacccgcggattcctaaacctgcccatcgaagacggcatgaatatccgcctcgtcgcagtgcttgcagccgtttggttcttggtctctgcgattccggcacttcttcgagtcccagaaattgaggcacaggtagctgccgaagaccaccccaaaggcctcatagctgcctacaaggatctctttgggcagatcgctgagctgtggaaacaagaccgcaactccgtgtatttcctcatcgcagcaactgttttccgtgacggactcgccggagtatttaccttcggtgccatccttgcggtctctgtgtacggactatctgccggtgatgtcctcctcttcggtgtcgcagccaacgtggtctctgcgttgggagcactcctcggaggattcctagacgatcgcgtcgggccaaaacccatcatcttgatttctcttgccatcatgatcgccgatgctgcaattctcttcttcgttgaaggccccactaatttctggatcttcggattaatcctctgtgcgtttgtgggacctgcacagtcagcgtcgagaagctatttaacacgtctttccccagatggccaggaaggccagctcttcggcctttatgccactaccggccgtgccgtgagttggatggtgccgtcgctgtttggtgtatttgtggggctcaccggcgatgaccgcactggtattttggccatcgcgctgattctgctattcggtattgtgctgctgagcatggtgaagccaccgcacaaggtgaagtagacaaagcgcccacaaggatt

SEQ ID NO: 268 - protein, 440 aa, Corynebacterium glutamicum
MTVQEFDRATKPTPKPPIVSWAFWDWGSASFNAVLVTFIFSVYLTDSVGATLPEGSNATSLYSMAVAIAGVIVAVVAPVMGRRSDIKGTRRRSLRMWTLVTVFLMFCLFTVKNTDPTFFWFGVAIMAIANITFEFAEVQYYAQLSQISTRENVGRVSGFGWSMGYFGGIVLLLVCYLGFVAGDGDTRGFLNLPIEDGMNIRLVAVLAAVWFLVSAIPALLRVPEIEAQVAAEDHPKGLIAAYKDLFGQIAELWKQDRNSVYFLIAATVFRDGLAGVFTFGAILAVSVYGLSAGDVLLFGVAANVVSALGALLGGFLDDRVGPKPIILISLAIMIADAAILFFVEGPTNFWIFGLILCAFVGPAQSASRSYLTRLSPDGQEGQLFGLYATTGRAVSWMVPSLFGVFVGLTGDDRTGILAIALILLFGIVLLSMVKPPHKVK

SEQ ID NO: 269 - DNA, 840 bp, Corynebacterium glutamicum
  CDS (101)..(817): RXN00535
aatcgcatggggcaccgtggtcagacaccggatcgcgctccgcaccccaaaagatggctccctaaggagctcacctttactcaatgctctgatgacaccgatgtggtgggcaggcatgagtaccgcgatgctggcatatttcttacaaacagtagcacttggtttcggcaccctcttggtagtgcaaccagtgcttgtcctgtcgctgatgttcacgctgccgctctcagcacgattcaatggctaccgactacgccgaactgaaatcttctgggctaccctcctcaccgtagccgtgggcatcatgatcgttttgggacgcccccttcccggaaacccccaccccccactcgatcgatggattccagtacttttagtcggcgttgcagtaatgggtggaatgtggctgcttgcggaatacgtattaaagaaggacaaagccctcatccttggtcttgtgacgggtgcattgtttggctacgtagcagtgatgtccaaagccgcggtggatctttttgtccatcaaggcataacgggactcatcttgaactgggaaggctacggcctaatcctcaccgcattacttggaacaatcgtgcagcagtattcctttaacgctggcgaactacaaaaatcgctacccgccatgaccattgccgaaccaattgttgccttcagtttgggctacttggttctgggcgaaaaattccaagtcgtggactgggaatggatcgccatgggcatcgcactactggtgatgattgtttccaccattgcactgtctcgtacaagcacaatgccggccggatcgaaaaggtaaaactccaaagttccccccga

SEQ ID NO: 270 - protein, 239 aa, Corynebacterium glutamicum
MWWAGMSTAMLAYFLQTVALGFGTLLVVQPVLVLSLMFTLPLSARFNGYRLRRTEIFWATLLTVAVGIMIVLGRPLPGNPHPPLDRWIPVLLVGVAVMGGMWLLAEYVLKKDKALILGLVTGALFGYVAVMSKAAVDLFVHQGITGLILNWEGYGLILTALLGTIVQQYSFNAGELQKSLPAMTIAEPIVAFSLGYLVLGEKFQVVDWEWIAMGIALLVMIVSTIALSRTSTMPAGSKR

SEQ ID NO: 271 - DNA, 2472 bp, Corynebacterium glutamicum
  CDS (101)..(2449): RXN00453
tagtggggcgtgaaaaaatagctcatttaagaggagaagcaaccccgtggcgaaattgctattcaggttggggcgatggtcctataatcgcaagtggattgtgatttcggcatggctacttattttggccattgttggtggtctggccctgacgatgcagaaggggttcagtaactctttcactattgaagacaccccttcgattgatgccactgtttctctggttgaaaatttccctgatcagacgaacccggtgacggccgccggagttaacgtggttttccaatccccggaaggaaccacgcttgatgatcctcagatgatgactgcgatggatgcagtcgttgattacattgaggacaatttgcctgattttggtgggggagagcgcttcggcaatcctgttgaggtgtctcctgcgttggaagagatggtcatcgagcagatgaccagcatggggcttcctgaggaaaccgctgcaaaggatgctgccaatctggcggtgttgagcgaagacaaaaccattggctacacctctttcaacattgatgttgaggccgcagaatatgtggagcaaaaacaccgcgatgtgatcaacgaagcgatgcaaatcggtgaagatttaggtgtccgggtggaagccggtggacctgctttcggtgatccaattcagattgaaaccaccagtgagatcatcggtattggcatcgcgttcatcgtgttgattttcacctttggttctttgattgctgcaggcttgcctttgattaccgcggtgatcggcgtgggcattggtgcgctggcaattgtgctggccacggcgtttactgatctcaacaatgtgactccagtgctcgcagtgatgattggcctggccgtgggcattgactacgcgctgtttattttgtctaggtaccgtgcggagtataagcgcatgccacgtgccgatgctgccggaatggcggtgggcacagctggtagtgcggtggtgtttgctggcgcgacggtgattatcgcgctggtagccctcatcattgcggatatcggattcctcacggccatgggtatttctgcggcgtttacggtgttcgtggctgtgctcattgcgttgacgtttatcccggcgctgttgggtgtgtttggtggtcatgcgttcaagggcaagatccctggaattggtggaaacccaacgccaaagcagacgtgggagcaagcgcttaatcgtcgttccaagggtcgctcatgggtcaagcttgtacagaaagcaccgggtcttgtggtggcagtggtggtcttgggtcttggtgccttgaccattcctgcaatgaacctgcagttgtcactgccttctgactccacctccaatattgataccactcagcgtcagtcggctgatttgatggcagagggctttggcgcgggcgttaatgcgccgttcttggtcatcgtcgatacgcatgaggtcaatgctgattccaccgcattgcagccactgattgaggcacaggagcctgaagagggcgagttcgatcgggagcaggcggctcgttttgctacctatatgtatgtcacccagacctacaattccaacatcgatgtgaagaatgcgcagatcatcagcgtcaatgatgatttcactgcggcgcagattctcgtgactccatacaccggacctgcggataaagagacccctgagttgatgcacgtgctgcgtgcgcaggaagctcagattgaggatgttacgggaactgaactgggtaccactgggtttacggcggttcagttggacattactgagcagctggaagacgcaatgccggtttacctcgctgtggttgttggtttggctattttcctcctcattctggtgttccgttccctgcttgttccgctggttgctggccttggcttcttgttgtctgtgggtgcggccttcggtgcgacggtgttggtctggcaggagggcttcggtggctttgtgaacacccctggtccgctgatttccttcatgccgatcttcctcatcggcgtgaccttcggtttggccatggactatcaggtgttccttgtgactcgcatgcgcgagcactacacccaccacaatggcaagggacagcctggttccaagtacaccccggttgagcagtcagtgattgaaggcttcacgcagggctcccgcgtggttacagcagcggcactgatcatgattgccgtgttcgtggcgtttattgatcagccgttgccatttattaagatcttcggtttcgcgttgggtgcgggcgtgtttttcgatgctttcttcattcgcatgggtctggtccccgcgtcgatgttcctgatgggcaaggccacgtggtggatgcctaagtggctggatcgaattctgccaagtttggacattgaaggcaccgcactggagaaggaatgggaggagaagcaggctgcacgttagacttggcacctatgtcagat

SEQ ID NO: 272 - protein, 783 aa, Corynebacterium glutamicum
VISAWLLILAIVGGLALTMQKGFSNSFTIEDTPSIDATVSLVENFPDQTNPVTAAGVNVVFQSPEGTTLDDPQMMTAMDAVVDYIEDNLPDFGGGERFGNPVEVSPALEEMVIEQMTSMGLPEETAAKDAANLAVLSEDKTIGYTSFNIDVEAAEYVEQKHRDVINEAMQIGEDLGVRVEAGGPAFGDPIQIETTSEIIGIGIAFIVLIFTFGSLIAAGLPLITAVIGVGIGALAIVLATAFTDLNNVTPVLAVMIGLAVGIDYALFILSRYRAEYKRMPRADAAGMAVGTAGSAVVFAGATVIIALVALIIADIGFLTAMGISAAFTVFVAVLIALTFIPALLGVFGGHAFKGKIPGIGGNPTPKQTWEQALNRRSKGRSWVKLVQKAPGLVVAVVVLGLGALTIPAMNLQLSLPSDSTSNIDTTQRQSADLMAEGFGAGVNAPFLVIVDTHEVNADSTALQPLIEAQEPEEGEFDREQAARFATYMYVTQTYNSNIDVKNAQIISVNDDFTAAQILVTPYTGPADKETPELMHVLRAQEAQIEDVTGTELGTTGFTAVQLDITEQLEDAMPVYLAVVVGLAIFLLILVFRSLLVPLVAGLGFLLSVGAAFGATVLVWQEGFGGFVNTPGPLISFMPIFLIGVTFGLAMDYQVFLVTRMREHYTHHNGKGQPGSKYTPVEQSVIEGFTQGSRVVTAAALIMIAVFVAFIDQPLPFIKIFGFALGAGVFFDAFFIRMGLVPASMFLMGKATWWMPKWLDRILPSLDIEGTALEKEWEEKQAAR

SEQ ID NO: 273 - DNA, 597 bp, Corynebacterium glutamicum
  CDS (101)..(574): RXN00932
cccaattaatttatgcacttcggtgaggttactcacaaagagtagcgtgcaaagcccagcaataaggtgatgtttcaacgattaggttacggtaggggccatgacgccacagaaacttcaccgttttgcagcccttttagaaatgggtacctggaccctgctgatcatcggcatgatcttaaaatacagtggagtgacagacgccgtaacccctattgccggcggtatccacggctttggcttcctctgttttgcagccatcaccatcaccgtgtggatcaataataagtggacattcccgcagggtatcgcaggtttgatcgtctctgttatcccgtgggctgcattgccatttgcattgtgggcagacaagaagggcctcgttgccggcggatggcgcttttcagatccgtccgaaaagccacacactttctttgacaagatcttggctcaattggtcaggcacccaatccgatccattttaattctgctggtgattatcgccgtcgtcttctctatcttgctggcgatgggaccaccttatgatccagatgccatcgcaaacactgtggattaaacaacagcctccttcacatg

SEQ ID NO: 274 - protein, 158 aa, Corynebacterium glutamicum
MTPQKLHRFAALLEMGTWTLLIIGMILKYSGVTDAVTPIAGGIHGFGFLCFAAITITVWINNKWTFPQGIAGLIVSVIPWAALPFALWADKKGLVAGGWRFSDPSEKPHTFFDKILAQLVRHPIRSILILLVIIAVVFSILLAMGPPYDPDAIANTVD

SEQ ID NO: 275 - DNA, 534 bp, Corynebacterium glutamicum
  CDS (65)..(511): RXN03022
acgcctgtgtcatccttttcattagagtggagaaaagcccatacagaaagttggcgcccgagcagtgatcatcaccgctggcatcttggtagcgaccgcgaccgccctcctaatgatcaccgcggtcagcgagtcaacgtacatcgtcatctccctcgccggcttctccctttatggccttggcctcggactcttcgccaccccagtcaccgatactgcgcttggaacacttcccaaagaccgtaccggcgctggtgcaggtgtattcaagatgtcctcttccctcggcgcagcactcggcatcgcaatctccacttcagtgttcctcgcacttcgcgacggcacctccatcaactccgacgtcgcactcgccggaacagtttcacttggcatcaacgttgtattcgcagcaacagccaccatcaccgcagcagtccttattccaaaagccgctggcaaagtctcacaaaccagcatcacccttcctgagccagctatcgctgtaaaaatctaaaacttcaccaggacagataa

SEQ ID NO: 276 - protein, 149 aa, Corynebacterium glutamicum
VIITAGILVATATALLMITAVSESTYIVISLAGFSLYGLGLGLFATPVTDTALGTLPKDRTGAGAGVFKMSSSLGAALGIAISTSVFLALRDGTSINSDVALAGTVSLGINVVFAATATITAAVLIPKAAGKVSQTSITLPEPAIAVKI

SEQ ID NO: 277 - DNA, 586 bp, Corynebacterium glutamicum
  CDS (101)..(586): RXN03151
ccgaacttggagctttgctgttggaggcagccaaatagtcccaatgtaaacgcactgggtagtatttgtttaaccatccacctcaaggagtaaaacgcacgtgctttcccacatcattgatgtcctcgccgacccgatcgatggcaccccacttgtaggcgccgaagatttctcacggttggtgtctgaatctgggcattcctacgatgttgctcgtcaagggtatgtcaccctggctggtggcgcaggtctgcgctattcaggcgatgatgcacagatgatcgcggatcgggaaaccttcctttctggcggtcacttcgcgcccttcgtggaagctgtcaccgagcatgttcaagatgtcgttgaccaggcaggccttagcgatgacgcacagccagtggtctgcgaaatcggcgcgggaaccggctactacttgtcccatacccttgattctgttgcaggatctcgcggaattggcattgacgtttccgtgcacgccgcaaagcgtttggcaaagtgtcaccctcgcgtcggcgcagtcatcgcgaacgcatgggcacgcctgccgattgcagataactcctcg

SEQ ID NO: 278 - protein, 162 aa, Corynebacterium glutamicum
VLSHIIDVLADPIDGTPLVGAEDFSRLVSESGHSYDVARQGYVTLAGGAGLRYSGDDAQMIADRETFLSGGHFAPFVEAVTEHVQDVVDQAGLSDDAQPVVCEIGAGTGYYLSHTLDSVAGSRGIGIDVSVHAAKRLAKCHPRVGAVIANAWARLPIADNSS

SEQ ID NO: 279 - DNA, 543 bp, Corynebacterium glutamicum
  CDS (1)..(543): RXN02832
cgcgggccagtgatggattatacaaatcaatcattagtagcatttttctttaaagcattaacgtcatatttaaagaaacacaattgtttatatgtccttgtagatccatatttaattgaaaatttacgcaatgcagacggtgaaattgttaaatcttatgataaccgagcatttgttagaacaatggataaattaggttataaacaccaaggtttccctgtaggttatgattcaatgagccaaatccgttggctgtcagtgttagatttaaaagataagactgaagaccaacttttaaaagaaatggattatcaaacgagacgtaatattaaaaaaacatatgatattggtgtcaaaactaaaacgttaacgattgatgaaacgcaaacttttttcgacttattccatatggctgaggaaaagcacggtttcaaattccgtgagttaccatactttgaagaaatgcaaaagttatacgatgaccacgccatgttaaagttggcgtatattgatttaaacgagtatttaaaaacgttgcaatta

SEQ ID NO: 280 - protein, 181 aa, Corynebacterium glutamicum
RGPVMDYTNQSLVAFFFKALTSYLKKHNCLYVLVDPYLIENLRNADGEIVKSYDNRAFVRTMDKLGYKHQGFPVGYDSMSQIRWLSVLDLKDKTEDQLLKEMDYQTRRNIKKTYDIGVKTKTLTIDETQTFFDLFHMAEEKHGFKFRELPYFEEMQKLYDDHAMLKLAYIDLNEYLKTLQL

SEQ ID NO: 281 - DNA, 1539 bp, Corynebacterium glutamicum
  CDS (101)..(1516): RXN00165
aaacctccccgggcccggcgcgcgaccgtccaagatgccggcgttggatgccaaattatggactctcaaagtggcgttgtcgcagcggccgtggagctttgtggcgtctgctggcatggcggcgtcttttatctgcaatgggttaacgcctgtgattgtgggtaaggcggtggatgaggctattggcacgagcgatctgcagcgattgtggttctggattgccatgttggcggttcttttcttaacggcgatgacggtgaactggattgctcggtacatgttggtgcggagccagcagttggtcagccatgatttgcgcatgttggtgactgatcggattcaagatccgcgtggttttgctggaaaagagcgcactgcgggtggattgttgtcgattgcgtcatcggatacgcagcgggtgggcgatatcgtcatgatgacggtgttcccggtggcggaattggcgtcgattatttatggcgccgtggtgatgtacagcattaatccgtggttgagtgtggctgtgctgattggtggaccgctgctggttgtggtggctattcaggtctcaaagccgttgcagaagcgttcgggtgctcgtcagcaggcggtggcacaggctgcggctactgcaactgatgtggtgcagggcttgagaattttgaagggtttgggcgcgattgtcacggtgcgccgtcggtacgaggcgatttctggtgaggcttatcggaagacggttcatgcggatgctgcggaagctcgcttgaatggtgtcaccgatgcggcgggcgccatctttgtgtccgcgttgggtattggagcaggatttttggcgctgcaaggtcagatgagtattggtgatttgatcacggttgtgggactcacacagtttttgatcatgccgatgaccatgcttggtcgaaatgtggcatcgcgctgggcatcggcggaggcgtcggcaaagcgtattaggggagtgctcggtgctgattttgagagagtgtctgcgcatgatgcggacaaggctgaggagattatccaacaacttgccaaaggtttgacggttattcgaggcactgatgagcagctcgttgaggtattagagcagttgccacgtactcgggtgattgtggctcctcatgcggcggatctttttgatcaaagtgtcagggacaatgtgcatcccgtggcagaggtcgcggagaaagccattgaagttgcctcctgtgacgatattccaggtggtagttccaagattgtgggcgagggtggacggttgctctcgggtggtcagcgtcagcgcgttgcactggctcgggcgattgcttttgatccagaggtgttggtgcttcaagatcccacaacggcagtggattctgtgacggagcaaaacattgctcagcaagtggcagcacaccgtgcaggaaaagtgaccattgtgtttagtgaggcacccgcgtggagtgcggtggctgatcaacacgttgaggcagctgctttgcgggaggttatgaaatgagtggggagacgtcgaaaagc

SEQ ID NO: 282 - protein, 472 aa, Corynebacterium glutamicum
VASAGMAASFICNGLTPVIVGKAVDEAIGTSDLQRLWFWIAMLAVLFLTAMTVNWIARYMLVRSQQLVSHDLRMLVTDRIQDPRGFAGKERTAGGLLSIASSDTQRVGDIVMMTVFPVAELASIIYGAVVMYSINPWLSVAVLIGGPLLVVVAIQVSKPLQKRSGARQQAVAQAAATATDVVQGLRILKGLGAIVTVRRRYEAISGEAYRKTVHADAAEARLNGVTDAAGAIFVSALGIGAGFLALQGQMSIGDLITVVGLTQFLIMPMTMLGRNVASRWASAEASAKRIRGVLGADFERVSAHDADKAEEIIQQLAKGLTVIRGTDEQLVEVLEQLPRTRVIVAPHAADLFDQSVRDNVHPVAEVAEKAIEVASCDDIPGGSSKIVGEGGRLLSGGQRQRVALARAIAFDPEVLVLQDPTTAVDSVTEQNIAQQVAAHRAGKVTIVFSEAPAWSAVADQHVEAAALREVMK

SEQ ID NO: 283 - DNA, 1470 bp, Corynebacterium glutamicum
  CDS (101)..(1447): RXN01190
cagggttttgatgagaacaacacacaccgcttcaagcattctgcgaagaatgatcaggcggcagcggggcaaggttgcgtttggcgcattctttttggggatgtggcagctgtcggaagcattggtgccgattgcgattggtttgatcgttgatcatgcggttctcacaaaagatctccgccgattagtggtcgggcttgtcgcttttgttgtgctgtttgtggtgttgagtttttctaatcgtttcggttcgcgcgcgttgaatagggccgtgaactttgaatcccatgcgctccgcgtagaggtagccgatcatgcgttgaagaatctggatccgcgcaatttggtgcctggcgaggtgatgtcgcggtccaccgcagatgcggattcttcgacgcgtattttcgggcagatcggaaccggtgtttcggctgcgacgggatttcttggtgcagcgacctacctgttgatcagtgactggctggtcgggttgttggtgcttgtgctggtaccgatcatttcgggagtggttgcactggctagcaagggcatttctaaaaggagtgtcacccagcaggagaagttggcggagtctggtgcgcaggcaagtgacatcatgatggggctgcgcgtgatcaaggcgatcggtggcgagcgttgggccgtgaagacttttgaaaaggcgtcgcaggcatcagcgagagcggcggttgatactgcagttgcttcgggcaaagtcgctggtattggtgagttgtccattgcggtgaatttggctgcggtgttgttgcttgctggttggcgggtcaccacgggggagttggggcctggccagttgatcgcaattgtgggtgtggcggtgtatttgtcagagccgattcgcttgctgagcaactcgattaatgcctcagctattgcgcacggtgcagcggagcgggtggctaatttcttaaacctcgacgaatctcaggcacagtacgaaagcagcgaaacaatcaatgacggcgaattcctcgtcatcgtgcccccagccagcacgcttccacacggcgacaatatcttggctacacctcatgctgccgacattttcgaaggtaccttgcggtcaaatatttccatgaatcatgaggacaacgtgccaattgatccgcaggtaattcgcgcttctggtctgactgacatcattgaggtggacggacttgatgcgccggtgcgcgatacgggaagcaatttatcgggtgggcagcgtcagcgagtggctttggccagggcgttgcatgcagacgcggaagtactggtgctgatggatccaaccagcgcggtggattcagtgacggaggtgtctatcgcgcaggggattaagcagctgcgagcaggcaaaaccaccattgtggtgagttcttcgcccgcgttttacaacttggcggatcgggtgatttcacatgtctaatttgatggcatcatcgacac

SEQ ID NO: 284 - protein, 449 aa, Corynebacterium glutamicum
MWQLSEALVPIAIGLIVDHAVLTKDLRRLVVGLVAFVVLFVVLSFSNRFGSRALNRAVNFESHALRVEVADHALKNLDPRNLVPGEVMSRSTADADSSTRIFGQIGTGVSAATGFLGAATYLLISDWLVGLLVLVLVPIISGVVALASKGISKRSVTQQEKLAESGAQASDIMMGLRVIKAIGGERWAVKTFEKASQASARAAVDTAVASGKVAGIGELSIAVNLAAVLLLAGWRVTTGELGPGQLIAIVGVAVYLSEPIRLLSNSINASAIAHGAAERVANFLNLDESQAQYESSETINDGEFLVIVPPASTLPHGDNILATPHAADIFEGTLRSNISMNHEDNVPIDPQVIRASGLTDIIEVDGLDAPVRDTGSNLSGGQRQRVALARALHADAEVLVLMDPTSAVDSVTEVSIAQGIKQLRAGKTTIVVSSSPAFYNLADRVISHV

SEQ ID NO: 285 - DNA, 1368 bp, Corynebacterium glutamicum
  CDS (101)..(1345): RXN01102
attctatggttgttgggagagatgacttaatttggaatcacgggctttaacacgcgctgacattgagcaacttcccagcatgtggaaaagcccaggtttcgtggctgtcctcgtggcggttgcagcagcgttcggcagttggtcactccttcttcccgtcgtaccgctagcggtcctcaacaacggcggatcaagcgctgtcgccggtgccaccactggcatcttcatggcagctacagtgatcactcagattttcactcccgctgcgctgcggaaaattggctacaccccagtgatggctttcgccgcattcatgctgggtgtgccagccatcgggtacatcttcagcgtcgagccaattccagtgctggtagtgtccgcacttcgaggaattgggttcggtgcgctcaccgtcgcagaatctgcgttggtggctgaactcgttcccgtacgcttcttgggcaaagcttctggaatgttgggcgtatttattggcctttcccaaatgcttttcctgcctgccgggttggcgttaggtgaccaatttggctacaacgtggtctatgttttaggtgccgttatcgcactagttgcagcggtgatgtgtctgcgtattccgcaggttaaggcagcggcaaagcagcaaccacaggtgagcgaacaggagcgttctgtttccacctggaagttggtgctggttccctccttggctgttaccagtttgtcaatgacttttggcgcagtgtcttcattccttccagctgcagtcattgagttagatccaggattaggtgctgcattagcgggtattattttatccattaccggtggttcttcaatggtgttccgctacctgtccggcgttatcgctgaccgccgcggtgtgcctggtaccacgatgattcctgctcagatcattgggttcttaggtgtcgttttaatcaccgtcacaatcttccaaggctggtccgtgtggcttttgattataggtgcagtgatgtttggtggtgcttttggcatggtgcaaaacgaagcgttgctttcaatgtttttccggcttcctcgcactagagtctccgaagcctccgccatctggaatatcgcctttgattcgggaacaggaatcggaagcttcctccttggcatagttgccgcatcgcttgcttacagtggtgcttttggttccggagccgtggtgattttgtttggaatcgttttgaccaccgccgatcgaatcattgggcggcaccgcattactgaatacaacaacacccgcgcgcgtttgcgccaggtgccagtcgctcggcgtgcagtgcaagggctgcgcaacaggcgcaaagatcgctaaaacgcttttcgacgccaccc

SEQ ID NO: 286 - protein, 415 aa, Corynebacterium glutamicum
VAVLVAVAAAFGSWSLLLPVVPLAVLNNGGSSAVAGATTGIFMAATVITQIFTPAALRKIGYTPVMAFAAFMLGVPAIGYIFSVEPIPVLVVSALRGIGFGALTVAESALVAELVPVRFLGKASGMLGVFIGLSQMLFLPAGLALGDQFGYNVVYVLGAVIALVAAVMCLRIPQVKAAAKQQPQVSEQERSVSTWKLVLVPSLAVTSLSMTFGAVSSFLPAAVIELDPGLGAALAGIILSITGGSSMVFRYLSGVIADRRGVPGTTMIPAQIIGFLGVVLITVTIFQGWSVWLLIIGAVMFGGAFGMVQNEALLSMFFRLPRTRVSEASAIWNIAFDSGTGIGSFLLGIVAASLAYSGAFGSGAVVILFGIVLTTADRIIGRHRITEYNNTRARLRQVPVARRAVQGLRNRRKDR

SEQ ID NO: 287 - DNA, 348 bp, Corynebacterium glutamicum
  CDS (101)..(325): RXN00788
cgcatccctctagttttccatcacctcaatgaacggcgctaactccggttcattgcgcaattgatccagcactgcttgcagtgaggcctcattagttggcatggcctcctccatcaacatcggagtgttcaaccttggaaatgctgttgctgcctggcttgctggtgcaaccatcaccacttcccttggactcacatcagccggattagttggcggtttgatgacgtccctcggactagtgttggccatcgtggctgtggttttgcgtcgaaaagcgcaaggcacccaagcgaccatcagcgttgtggagcaccagcccgcccaataaataatttctctcttctaatt

SEQ ID NO: 288 - protein, 75 aa, Corynebacterium glutamicum
MASSINIGVFNLGNAVAAWLAGATITTSLGLTSAGLVGGLMTSLGLVLAIVAVVLRRKAQGTQATISVVEHQPAQ

SEQ ID NO: 289 - DNA, 1764 bp, Corynebacterium glutamicum
  CDS (101)..(1741): RXN02119
ttcggtccgctctggcaaaaatggctggctgccacctcggcgcagcagcttaagggctgggcttaaattgcttgtcgacgcctagtgccacaatggagacatgaccgaaacacttgtggtgaatggccttgcaggcggctatgggcaccgcacattatttaacgatgtgaatctcaccgtagctgccggcgatgtcgtgggcgttgtcggcgtcaatggcgctggtaaatccacatttctaaaaattctggcgggcgtggaaaagccactggctggaactatcgcgctttcgccagccgatgcttttgtgggctacttgccacaggaacacacccgcacgtctggagagacgatcgcagtttacattgctcgtcgaaccggctgccaagctgcaacaactgccatggatgacaccgccgaagcgtttggtgcggatccagacaacgctgccttggccgatgcatacgccgaggcgctggatcggtggatggccagtggcgcagccgatttggatgaacgcatccccatcgtgctcgctgatttgggctttgagcttcccacctcgacgctgatggaaggactttcaggcgggcaggcagcccgggtcgggctggcggcgttactgttgtcacgttttgacattgtgcttctcgacgagcccaccaacgatttggatctcgacggtcttgagcaactggagaattttgttcaggggcttcgcgggggagtcgtactggtcagccatgatcgtgagtttctttccaggtgtgtgaccactgtgctggaactcgatctgcaccaaaattcccaccatgtttatggcggtggatatgattcctaccttgaggaacgcgcagtgctacgccagcacgcccgtgaccaatatgaggaatttgcggaaaagaagaaggaccttgtggcacgtgctcgaacgcagcgtgaatggtctagtcacggtgtccgcaatgctattaaacgtgcacctgacaacgacaaacttcggaagaaagccgctgcggaatccagtgaaaagcaggctcaaaaagtccgccagatggaaagccgcatcgctcggttagaagaagttgaagagccacgtaaagaatggaaactgcagttcagcgtcggtaaggcgtcgcggtcaagttctgttgtttccacgttgaatgatgcaagcttcacccaaggcgatttcaccttgggaccagtatccatccaagtaaatgctggcgatcgcattggcatcacaggacccaacggtgctggtaaatccacattgctgcgcggactattgggaaaccaagaacccaccagcggtactgccacgatgggcacgagcgtggcgatcggagaaatcgatcaggcacgagcgttacttgatccacagttgccactgatttctgcgtttgaaaagcatgttccagacttaccgatcagtgaggtgcgcacactgctcgcgaaatttgggctgaatgataatcatgtggaacgggacgtcgaaaagctatctcctggcgagcgcacgcgcgccggacttgcgctgctacaggtgcggggcgtcaacgtgcttgttcttgatgagcccaccaaccaccttgacctggaggccatcgagcaattggagcaagcgttggcctcgtatgatggtgtgttgctgctggtcacgcacgatcgtcgcatgttggacgctgtgcagaccaatcgtcgttggcatgtcgaggctggcgaagttagggagctataaccgtttccgtattgatgcca

SEQ ID NO: 290 - protein, 547 aa, Corynebacterium glutamicum
MTETLVVNGLAGGYGHRTLFNDVNLTVAAGDVVGVVGVNGAGKSTFLKILAGVEKPLAGTIALSPADAFVGYLPQEHTRTSGETIAVYIARRTGCQAATTAMDDTAEAFGADPDNAALADAYAEALDRWMASGAADLDERIPIVLADLGFELPTSTLMEGLSGGQAARVGLAALLLSRFDIVLLDEPTNDLDLDGLEQLENFVQGLRGGVVLVSHDREFLSRCVTTVLELDLHQNSHHVYGGGYDSYLEERAVLRQHARDQYEEFAEKKKDLVARARTQREWSSHGVRNAIKRAPDNDKLRKKAAAESSEKQAQKVRQMESRIARLEEVEEPRKEWKLQFSVGKASRSSSVVSTLNDASFTQGDFTLGPVSIQVNAGDRIGITGPNGAGKSTLLRGLLGNQEPTSGTATMGTSVAIGEIDQARALLDPQLPLISAFEKHVPDLPISEVRTLLAKFGLNDNHVERDVEKLSPGERTRAGLALLQVRGVNVLVLDEPTNHLDLEAIEQLEQALASYDGVLLLVTHDRRMLDAVQTNRRWHVEAGEVREL

SEQ ID NO: 291 - DNA, 1638 bp, Corynebacterium glutamicum
  CDS (101)..(1615): RXN01605
attgaagtcagcgccgaggaagccgcgagggaatcagacgacgggcacctactacttcggcattgaaattccgaagaacttcagcgattctattgccagcgtgaccagcgattcacccgcgccagcaaccgtcaacgcggtattcaacaacagcaacggcttcattgcctccatgctgggcaaccaggtggtcaacactgttgtggagaccatggacacggaattcggcgtccgcattgtggataacatgctcgtcggtttctccaccttgggcgacggcatgaaccaagccgccgaaggtgccactacgctcagcgatggcgtcggttccgccaacgacggtgcagttcagcttgccgacggcgcggtcaccctgcgcgacggcatcgcaagtgccaatgagggtgcgcaatcgcttgccgacggcgccagccagctcgacaccggcctcggctccgcggctacaggcagccaaacgctcgccgacggtctatccagcctgtctgcgggcaccgcccaactaggccaaggcgcaacccaggtttcagatggcgtgggccaacttgtcgaccaagtagcaccactgaccgcctatgttccagacatcaactctcagttgatcaccctgcgcgacggcgcagccaccattgcctctgaactatctgatccctccagcacctaccgctccggcgtggactccgctgtgagcgcatcccagcaactagcagccggcctgcaaaccctgaaagacggatccagccaactcagcatcggtgcacgcaccctcgctgatggcaccagccaattggccgcaggttccgaacagctagttgttggcgcacaagcactgcgcgacggcaccgtccagcttgatgaaggctccagcgaactcgccctcaaactcaccgacggcgcaagccaagtaccaaccttcgctgacggcgcagacaccaccatcgcaaccccagttgaaacagaacaagcaggagacaccacaccgctcttcggtattggtctcgcaccattcttcatggctgtcggcctgttcatgggagcaaccgttgcctggatgatcctgcacccaatcagtcgccgcgcactcgactcccgcatgggaggcttccgaggcaccctggcaagctaccttccatcaacagtcttaggccttggccaagcaaccatcatgtgggcagtactgtacttcctgctcgacctcaatccagctcacccagctggactgtggatggcgatggtcgccatctcatgggtattcatctccattacccatatgttcaacaacgtggcaggaccctccgcaggccgtgtgctgtccatcgtgatgatgtccttccagctagtctcctccggtggcctatacccaccagaaacccagccagcattcttccactggttccacacctacgacccgatcacctacgcagtcaacctcgtgcgccaaatgatcttcaacgaaaccccatccaacgacccacgcttcatacaagcaatctgggtactgctcttcatctgggcactgatgctcgccatctccaccctggcgaatagaacaaacaaggttcttcgcatgaaggactaccacccagaactgaaggtctaaaagcttttcccgcccggttc

SEQ ID NO: 292 - protein, 505 aa, Corynebacterium glutamicum
VTSDSPAPATVNAVFNNSNGFIASMLGNQVVNTVVETMDTEFGVRIVDNMLVGFSTLGDGMNQAAEGATTLSDGVGSANDGAVQLADGAVTLRDGIASANEGAQSLADGASQLDTGLGSAATGSQTLADGLSSLSAGTAQLGQGATQVSDGVGQLVDQVAPLTAYVPDINSQLITLRDGAATIASELSDPSSTYRSGVDSAVSASQQLAAGLQTLKDGSSQLSIGARTLADGTSQLAAGSEQLVVGAQALRDGTVQLDEGSSELALKLTDGASQVPTFADGADTTIATPVETEQAGDTTPLFGIGLAPFFMAVGLFMGATVAWMILHPISRRALDSRMGGFRGTLASYLPSTVLGLGQATIMWAVLYFLLDLNPAHPAGLWMAMVAISWVFISITHMFNNVAGPSAGRVLSIVMMSFQLVSSGGLYPPETQPAFFHWFHTYDPITYAVNLVRQMIFNETPSNDPRFIQAIWVLLFIWALMLAISTLANRTNKVLRMKDYHPELKV

SEQ ID NO: 293 - DNA, 664 bp, Corynebacterium glutamicum
  CDS (101)..(664): RXN01091
tcgtcggaaaaactggcgatactattgataacgggcatgggttcaccttcgataaagcacggtctatgctggactatcgccttttgacacgagtatcgcaatggtcccgaacacagtccttatccatgacgaaaccgccgatctggcgacgcagatccagcggctggaacatatcatggcgtgcctgcgcgatccggtcagcggatgcccgtgggatattgaacagacctttgccagcatcgcgccccacacgattgaggaaggctacgaggttgccgacgccatcgcgcaggaagactggcccgagctacgcggcgagttgggcgatttgctgtttcagaccgtgtttcacgcccaaatggcgcgcgaggcaggccatttcgctttggttgacgtggtgaaggcaatttcggacaagatggttttgcgccatccgcacgtgttcggcgcgcagtcgaacgcgaaatccgccgaccagcaggtggaagattgggaagtcatcaaggcgcccgagcgcgcgggcaaagcgcaaaagggcgttttggatggcgtcgcgctgggactgcctgccctgatgcgcgcgacgaagctgcaaaacaacgccgcgcgcgttgggtttgattggcccgacattgggcaggtacttggaaaggtgaccgaggaa

SEQ ID NO: 294 - protein, 188 aa, Corynebacterium glutamicum
MVPNTVLIHDETADLATQIQRLEHIMACLRDPVSGCPWDIEQTFASIAPHTIEEGYEVADAIAQEDWPELRGELGDLLFQTVFHAQMAREAGHFALVDVVKAISDKMVLRHPHVFGAQSNAKSADQQVEDWEVIKAPERAGKAQKGVLDGVALGLPALMRATKLQNNAARVGFDWPDIGQVLGKVTEE

SEQ ID NO: 295 - DNA, 357 bp, Corynebacterium glutamicum
  CDS (101)..(334): RXS02979
ctaggtcaaggaacttcactcggctagtccttagactcaaatgtgttcagacaaacactggcaccgtaaggcacgaaagttaccgaaaggactggttcccatgaccgccccaaacactctcaagcaaacaactcttcgctctgatgagttctcttgcccatcctgtgtctccaagattgaaaacaaattgaatggattggatggcgtcgacaatgcagaggtgaagttctcctccggaagaatccttgttgatcacgaccccagcaaggtctctatcaaggatctagtcgctgcagtcgcagaggttggctacaccgcaaagccatcagcaatctaaaactctcagttagaccatta

SEQ ID NO: 296 - protein, 78 aa, Corynebacterium glutamicum
MTAPNTLKQTTLRSDEFSCPSCVSKIENKLNGLDGVDNAEVKFSSGRILVDHDPSKVSIKDLVAAVAEVGYTAKPSAI

SEQ ID NO: 297 - DNA, 357 bp, Corynebacterium glutamicum
  CDS (101)..(334): RXS02987
gttgtttgatccaggtcaaggaattaacccggaaaggaccgtatctttaaaggtgcaagcacaggaacatgacgataaaagatgaaaggacctggttacgatgaccgcccccgccacgctgaagaacaccaccttgcgctctgatgagttcacctgtccgagctgtgtcgccaagatcgaaaacaagctgaatggtttggacggcgtggagaatgcggaggtgaagttctcctccggacgcatcctgatcacccacgacccacagaaggtctccgtacgtgacctggtcaccgcggtagccgaggtcggttacaccgccaagccgtcggcgatctgacgcactcccgaccccacaag

SEQ ID NO: 298 - protein, 78 aa, Corynebacterium glutamicum
MTAPATLKNTTLRSDEFTCPSCVAKIENKLNGLDGVENAEVKFSSGRILITHDPQKVSVRDLVTAVAEVGYTAKPSAI

SEQ ID NO: 299 - DNA, 492 bp, Corynebacterium glutamicum
  CDS (101)..(469): RXS03095
aacgcctcaattagtgccagaccttgccgaccgcagaccaaacttcaccatttcaaaccatccctagccacaacaacggcagttgtgcaatgatctgcgtatgaatgcagataagaaaatgtgcggaatgaacccggatagccaatacgtcgaacttgccgtcgaagttttcggactcctcgcggacgccactcgagttcgcatcatcttggcacttcgaaacagtggtgaactttccgtaaaccacctcgcggacatcgtcgataaatcccccgcagcagtttcccaacacctcgcccggctgcgcatggcccgaatcgtgtccacccgtcaagaaggtcaacgagttttctacaaactcaccaatgaacacgcatcacagctagtctccgacgctatttttcaggcggaacacaccattgcggacggccagactcccccacaccaccaccgagaacgagaacaatcatgaccacccacagtcaccaagaa

SEQ ID NO: 300 - protein, 123 aa, Corynebacterium glutamicum
MNADKKMCGMNPDSQYVELAVEVFGLLADATRVRIILALRNSGELSVNHLADIVDKSPAAVSQHLARLRMARIVSTRQEGQRVFYKLTNEHASQLVSDAIFQAEHTIADGQTPPHHHREREQS

SEQ ID NO: 301 - protein, 10 aa, Corynebacterium glutamicum
APALGPTLSG

SEQ ID NO: 302 - protein, 10 aa, Corynebacterium glutamicum
  All occurrences of Xaa indicate any amino acid
GXXXGPXXGG

SEQ ID NO: 303 - DNA, 20 bp, Corynebacterium glutamicum
ctccaggattgctccgaagg

SEQ ID NO: 304 - DNA, 20 bp, Corynebacterium glutamicum
cacagtggttgaccactggc

SEQ ID NO: 305 - DNA, 18 bp, Artificial Sequence
  Description of Artificial Sequence: primer
ggaaacagtatgaccatg

SEQ ID NO: 306 - DNA, 17 bp, Artificial Sequence
  Description of Artificial Sequence: primer
gtaaaacgacggccagt

What is claimed:

1. An isolated nucleic acid molecule consisting of the nucleotide sequence set forth in SEQ ID NO:1, or a complement thereof.

2. An isolated nucleic acid molecule which encodes a polypeptide consisting of the amino acid sequence set forth in SEQ ID NO:2, or a complement thereof.

* * * * *